(12) United States Patent
Kröger et al.

(10) Patent No.: US 7,485,444 B2
(45) Date of Patent: Feb. 3, 2009

(54) METHODS FOR PRODUCING SULPHUROUS FINE CHEMICALS BY FERMENTATION USING METH-CODING CORNYEFORM BACTERIA

(75) Inventors: Burkhard Kröger, Limburgerhof (DE); Oskar Zelder, Speyer (DE); Corinna Klopprogge, Ludwigshafen (DE); Hartwig Schröder, Nußloch (DE); Stefan Häfner, Ludwigshafen (DE)

(73) Assignee: Evonik Degussa GmbH, Essen (DE)

( * ) Notice: Subject to any disclaimer, the term of this patent is extended or adjusted under 35 U.S.C. 154(b) by 385 days.

(21) Appl. No.: 10/511,302

(22) PCT Filed: Apr. 16, 2003

(86) PCT No.: PCT/EP03/04010

§ 371 (c)(1),
(2), (4) Date: Oct. 15, 2004

(87) PCT Pub. No.: WO03/087386

PCT Pub. Date: Oct. 23, 2003

(65) Prior Publication Data

US 2006/0223149 A1    Oct. 5, 2006

(30) Foreign Application Priority Data

Apr. 17, 2002   (DE)   ............................... 102 17 058

(51) Int. Cl.
*C12P 13/12*   (2006.01)
*C12N 15/09*   (2006.01)
*C12N 15/77*   (2006.01)

(52) U.S. Cl. ...................... 435/113; 435/69.1; 435/476

(58) Field of Classification Search ........................ None
See application file for complete search history.

(56) References Cited

U.S. PATENT DOCUMENTS

| | | | |
|---|---|---|---|
| 4,489,160 A | 12/1984 | Katsumata et al. | |
| 4,601,893 A | 7/1986 | Cardinal | |
| 5,158,891 A | 10/1992 | Takeda et al. | |
| 5,175,108 A | 12/1992 | Bachmann et al. | |
| 5,965,391 A | 10/1999 | Reinscheid et al. | |
| 2003/0170775 A1 | 9/2003 | Pompejus et al. | |

FOREIGN PATENT DOCUMENTS

| | | |
|---|---|---|
| DE | 10046870 A1 | 3/2002 |
| EP | 0375889 A2 | 6/1989 |
| EP | 0375889 A3 | 6/1989 |
| EP | 0 375 889 A2 | 7/1990 |
| EP | 0472869 B1 | 3/1992 |
| EP | 1108790 A2 | 6/2001 |
| JP | 10-229891 A | 9/1998 |
| WO | WO 96/15246 A1 | 5/1996 |
| WO | WO 02/10209 A1 | 2/2002 |

OTHER PUBLICATIONS

Ludwig et al., Ann Rev. Biochem., 66:269-313, 1997.*
Banerjee, R.V., et al. "Cobalamin-dependent methionine synthase." *FASEB J.* Mar. 1990; 4(5):1450-9.
Ben-Bassat, A., et al. "Processing of the initiation methionine from proteins: properties of the *Escherichia coli* methionine aminopeptidase and its gene structure." *J. Bacteriol.* Feb. 1987; 169(2):751-7.
Bernard, P., et al. "The F plasmid CcdB protein induces efficient ATP-dependent DNA cleavage by gyrase." *J Mol Biol.* Dec. 5, 1993; 234(3):534-41.
Bolivar, F. "Molecular cloning vectors derived from the CoLE1 type plasmid pMB1." *Life Sci.* Sep. 3, 1979; 25(10):807-17.
Butler, B.A. "Sequence analysis using GCG." *Methods Biochem Anal.* 1998; 39:74-97.
Drennan, C.L., et al. "Cobalamin-dependent methionine synthase: the structure of a methylcobalamin-binding fragment and implications for other B12-dependent enzymes." *Curr Opin Struct Biol.* Dec. 1994; 4(6):919-29.
Dunican, L.K., et al. "High frequency transformation of whole cells of amino acid producing coryneform bacteria using high voltage electroporation." *Biotechnology* 7. 1989; 1067-70.
Eikmanns, B.J., et al. "Molecular aspects of lysine, threonine, and isoleucine biosynthesis in *Corynebacterium glutamicum*." *Biological Chemstry.* 1993-94; 64(2):145-63.
Eikmanns, B.J., et al. "A family of *Corynebacterium glutamicum/ Escherichia coli* shuttle vectors for cloning, controlled gene expression, and promoter probing." *Gene.* Jun. 15, 1991; 102(1):93-8.
Eikmanns, B.J., et al. "Identification, sequence analysis, and expression of a *Corynebacterium glutamicum* gene cluster encoding the three glycolytic enzymes glyceraldehyde-3-phosphate dehydrogenase, 3-phosphoglycerate kinase, and triosephosphate isomerase." *J Bacteriol.* Oct. 1992; 174(19):6076-86.
Eikmanns, B.J., et al. "Nucleotide sequence, expression and transcriptional analysis of the *Corynebacterium glutamicum* gltA gene encoding citrate synthase." *Microbiology.* Aug. 1994; 140 (Pt 8):1817-28.
Grant, S.G., et al. "Differential plasmid rescue from transgenic mouse DNAs into *Escherichia coli* methylation-restriction mutants." *Proc Natl Acad Sci USA.* Jun. 1990; 87(12):4645-9.
Guerrero, C., et al. "Directed mutagenesis of a regulatory palindromic sequence upstream from the *Brevibacterium lactofermentum* tryptophan operon." *Gene.* Jan. 28, 1994; 138(1-2):35-41.
Hochuli, E., et al. "Genetic approach to facilitate purification of recombinant proteins with a novel metal chelate adsorbent." *Biotechnology.* Nov. 1988; 1321-5.
Jarrett, J.T., et al. "Purification and assay of cobalamin-dependent methionine synthase from *Escherichia coli*." *Methods Enzymol.* 1997; 281:196-213.
Jensen, P.R., et al. "Artificial promoters for metabolic optimization." *Biotechnol Bioeng.* Apr. 20-May 5, 1998; 58(2-3):191-5.

(Continued)

*Primary Examiner*—Nancy Vogel
(74) *Attorney, Agent, or Firm*—Lahive & Cockfield, LLP

(57) ABSTRACT

The invention relates to methods for the fermentative production of sulfur-containing fine chemicals, in particular L-methionine, by using bacteria which express a nucleotide sequence coding for a methionine synthase (metH) gene.

10 Claims, No Drawings

OTHER PUBLICATIONS

Kase, H., et al. "L-methionine production by methionine analog-resistant mutants of *corynebacterium glutamicum.*" *Agr. Biol. Chem.* 1975; 39(1):153-60.

Kohara, Y., et al. "The physical map of the whole *E. coli* chromosome: application of a new strategy for rapid analysis and sorting of a large genomic library." *Cell.* Jul. 31, 1987; 50(3):495-508.

LaBarre, J., et al. "Gene replacement, integration, and amplification at the gdhA locus of *Corynebacterium glutamicum.*" *J Bacteriol.* Feb. 1993; 175(4):1001-7.

Lennox, E.S. "Transduction of linked genetic characters of the host by bacteriophage P1." *Virology.* Jul. 1955; 1(2):190-206.

Liebl, W., et al. "Transfer of *Brevibacterium divaricatum* DSM 20297T, "*Brevibacterium flavum* " DSM 20411, "*Brevibacterium lactofermentum*" DSM 20412 and DSM 1412, and *Corynebacterium glutamicum* and their distinction by rRNA gene restriction patterns." *Int J Syst Bacteriol.* Apr. 1991; 41(2):255-60.

Liebl, W., et al. "High efficiency electroporation of intact *Corynebacterium glutamicum* cells." *FEMS Microbiol Lett.* Dec. 1989; 53(3):299-303.

Ludwig, M.L., et al. "Structure-based perspectives on B12-dependent enzymes." *Annu Rev Biochem.* 1997; 66:269-313.

Makrides, S.C. "Strategies for achieving high-level expression of genes in *Escherichia coli.*" *Microbiol Rev.* Sep. 1996; 60(3):512-38.

Malumbres, M., et al. "Codon preference in *corynebacteria.*" *Gene.* Nov. 30, 1993; 134(1):15-24.

Marck, C. "'DNA Strider': a 'C' program for the fast analysis of DNA and protein sequences on the Apple Macintosh family of computers." *Nucleic Acids Res.* Mar. 11, 1988; 16(5):1829-36.

Martin, J.F., et al. "Cloning systems in amino acid-producing *corynebacteria.*" *Biotechnology.* 1987; 5:137-46.

Motoyama, H., et al. "Overproduction of L-Lysine from methanol by *Methylobacillus glycogenes* derivatives carrying a plasmid with a mutated dapA gene." *Appl Environ Microbiol.* Jul. 2001; 67(7):3064-70.

O'Regan, M., et al. "Cloning and nucleotide sequence of the phosphoenolpyruvate carboxylase-coding gene of *Corynebacterium glutamicum* ATCC13032." *Gene.* 1989; 77:237-51.

Patek, M., et al. "Promoters from *Corynebacterium glutamicum*: cloning, molecular analysis and search for a consensus motif." *Microbiology.* May 1996; 142 ( Pt 5):1297-309.

Reinscheid, D.J., et al. "Stable expression of hom-1-thrB in *Corynebacterium glutamicum* and its effect on the carbon flux to threonine and related amino acids." *Applied and Environmental Microbiology.* Jan. 1994; 60(1):126-32.

Sahin-Toth, M., et al. "Cysteine scanning mutagenesis of the N-terminal 32 amino acid residues in the lactose permease of *Escherichia coli.*" *Protein Sci.* Feb. 1994; 3(2):240-7.

Sahm, H., et al. "Pathway analysis and metabolic engineering in *Corynebacterium glutamicum.*" *Biol. Chem.* Sep.-Oct. 2000; 381(9-10):899-910.

Sanger, F., et al. "DNA sequencing with chain-terminating inhibitors." *Proc Natl Acad Sci USA.* Dec. 1977; 74(12):5463-7.

Schäefer, A., et al. "Small mobilizable multi-purpose cloning vectors derived from the *Escherichia coli* plasmids pK18 and pK19: selection of defined deletions in the chromosome of *Corynebacterium glutamicum.*" *Gene.* 1994; 145:69-73.

Schrumpf, B., et al. "A functionally split pathway for lysine synthesis in *Corynebacterium glutamicium.*" *J Bacteriol.* Jul. 1991; 173(14):4510-6.

Schwarzer, A., et al. "Manipulation of *Corynebacterium glutamicum* by gene disruption and replacement." *Biotechnology.* Jan. 1991; 9(1):84-7.

Serwold-Davis, T.M., et al. "Localization of an origin of replication in *Corynebacterium diphtheriae* broad host range plasmid pNG2 that also functions in *Escherichia coli.*" *FEMS Microbiol Lett.* Jan. 1, 1990; 54(1-3):119-23.

Simon, R., et al. "A broad host range mobilization system for in vivo genetic engineering: transposon mutagenesis in gram negative bacteria." *Biotechnology.* 1983; 1:784-91.

Sonnen, H., et al. "Characterization of pGA1, a new plasmid from *Corynebacterium glutamicum* LP-6." *Gene.* Oct. 30, 1991; 107(1):69-74.

Spratt, B.G., et al. "Kanamycin-resistant vectors that are analogues of plasmids pUC8, pUC9, pEMBL8 and pEMBL9." *Gene.* 1986; 41(2-3):337-42.

Staden, The current status and portability of our sequence handling software. *Nucleic Acids Res.* Jan. 10, 1986; 14(1):217-31.

Tauch, A., et al. "*Corynebacterium glutamicum* DNA is subjected to methylation-restriction in *Escherichia coli.*" *FEMS Microbiol Lett.* Nov. 1, 1994; 123(3):343-7.

Tauch, A., et al. "The erythromycin resistance gene of the *Corynebacterium xerosis* R-plasmid pTP10 also carrying chloramphenicol, kanamycin, and tatracycline resistances is capable of transposition in *Corynebacterium glutamicum.*" *Plasmid.* May 1995; 33(3):168-79.

Thierbach, G., et al. "Transformation of spheroplasts and protoplasts of *Corynebacterium glutamicum.*" *Applied Microbiology and Biotechnology.* 1988; 29:356-62.

Tsuchiya, M., et al. "Genetic control systems of *Escherichia coli* can confer inducible expression of cloned genes in coryneform bacteria." *Biotechnology.* 1998; 6:428-30.

Vieira, J., et al. "The pUC plasmids, an M13mp7-derived system for insertion mutagenesis and sequencing with synthetic universal primers." *Gene.* Oct. 1982; 19(3):259-68.

Wahl, G.M., et al. "Cosmid vectors for rapid genomic walking, restriction mapping, and gene transfer." *Proc Natl Acad Sci USA.* Apr. 1987; 84(8):2160-4.

Database EMBL Online. Methionin-Synthase, 1170 aa, 100% Seq. ID. No. 2,1. Apr. 1, 2001. "Putative Methionine Synthase" retrieve from EBI database accession No. q9ewh3.

* cited by examiner

METHODS FOR PRODUCING SULPHUROUS FINE CHEMICALS BY FERMENTATION USING METH-CODING CORNYEFORM BACTERIA

RELATED APPLICATION

The current application claims priority from the following International Patent Application filed pursuant to Patent Cooperation Treaty (PCT) on Apr. 16, 2003, designating the United States, which claims priority from German Patent Application S/N 10217058.4 DE filed on Apr. 17, 2002. The International Patent Application is assigned International Application Number, PCT/EP03/04010 and names all the same inventors as this application: Ser. No. 10/511,302 entitled Methods for Producing Sulphurous Fine Chemicals by Fermentation Using Meth-Coding Cornyeform Bacteria. The International Patent Application was published in German on Oct. 23, 2003, and assigned International Publication Number: WO 2003/087386.

TECHNICAL FIELD OF INVENTION

The invention relates to a method for the fermentative production of sulfur-containing fine chemicals, in particular L-methionine, by using bacteria which express a nucleotide sequence coding for a methionine synthase (metH) gene.

BACKGROUND

Sulfur-containing fine chemicals such as, for example, methionine, homocysteine, S-adenosylmethionine, glutathione, cysteine, biotin, thiamine, lipoic acid are produced in cells via natural metabolic processes and are used in many branches of industry, including the food, animal feed, cosmetics and pharmaceutical industries. These substances which are collectively referred to "sulfur-containing fine chemicals" include organic acids, both proteinogenic and nonproteinogenic amino acids, vitamins and cofactors. They are most expediently produced on a large scale by means of cultivating bacteria which have been developed in order to produce and secrete large amounts of the substance desired in each case. Organisms which are particularly suitable for this purpose are coryneform bacteria, Gram-positive nonpathogenic bacteria.

It is known that amino acids are produced by fermentation of strains of coryneform bacteria, in particular *Corynebacterium glutamicum*. Due to the great importance, the production processes are constantly improved. Process improvements can relate to measures regarding technical aspects of the fermentation, such as, for example, stirring and oxygen supply, or to the nutrient media composition such as, for example, sugar concentration during fermentation or to the work-up to give the product, for example by ion exchange chromatography, or to the intrinsic performance properties of the microorganism itself.

A number of mutant strains which produce an assortment of desirable compounds from the group of sulfur-containing fine chemicals have been developed via strain selection. The performance properties of said microorganisms are improved with respect to the production of a particular molecule by applying methods of mutagenesis, selection and mutant selection. However, this is a time-consuming and difficult process. In this way strains are obtained, for example, which are resistant to antimetabolites or inhibitors such as, for example, the methionine analogs α-methylmethionine, ethionine, norleucine, n-acetylnorleucine, S-trifluoromethyl-homocysteine, 2-amino-5-heprenoitic acid, selenomethionine, methioninesulfoximine, methoxine, 1-aminocyclopentanecarboxylic acid or which are auxotrophic for metabolites important for regulation and which produce sulfur-containing fine chemicals such as, for example, L-methionine.

Methods of recombinant DNA technology have also been used for some years to improve *Corynebacterium* strains producing L-amino acids by amplifying individual amino-acid biosynthesis genes and investigating the effect on amino acid production.

WO-A-02/10209 describes a method for the fermentative production of L-methionine using L-methionine-producing coryneform bacteria in which at least the metH gene is overexpressed and also the coding metH sequence from *C. glutamicum* ATCC 13032.

SUMMARY OF THE INVENTION

It is an object of the present invention to provide a novel method for the improved fermentative production of sulfur-containing fine chemicals, in particular L-methionine.

We have found that this object is achieved by providing a method for the fermentative production of a sulfur-containing fine chemical, comprising the expression of a heterologous nucleotide sequence coding for a protein with metH activity in a coryneform bacterium.

The invention firstly relates to a method for the fermentative production of at least one sulfur-containing fine chemical, which comprises the following steps:

a) fermentation of a coryneform bacteria culture producing the desired sulfur-containing fine chemical, the coryneform bacteria expressing at least one heterologous nucleotide sequence which codes for a protein with methionine synthase (metH) activity;

b) concentration of the sulfur-containing fine chemical in the medium or in the bacterial cells, and c) isolation of the sulfur-containing fine chemical, which preferably comprises L-methionine.

The above heterologous metH-encoding nucleotide sequence is preferably less than 70% homologous to the metH-encoding sequence from *Corynebacterium glutamicum* ATCC 13032. The metH-encoding sequence is derived preferably from any of the following organisms of list I:

| List I | |
|---|---|
| *Streptomyces coelicolor* | ATCC 10147 |
| *Anabaena* sp. | ATCC 27892 |
| *Synechocystis* sp. | ATCC 27184 |
| *Prochlorococcus marinus* | PCC 7118 |
| *Thermus thermophilus* | ATCC 27634 |
| *Bacillus halodurans* | ATCC 21591 |
| *Bacillus stearothermophilus* | ATCC 12980 |
| *Vibrio cholerae* | ATCC 39315 |
| *Sinorhizobium meliloti* | ATCC 4399 |
| *Escherichia coli* K12 | ATCC 55151 |
| *Salmonella typhimurium* | ATCC 15277 |
| *Salmonella typhi* | ATCC 12839 |
| *Pseudomonas fluorescens* | ATCC 13525 |
| *Pseudomonas aeruginosa* | ATCC 17933 |
| *Nitrosomonas europeae* | ATCC 19718 |
| *Bordetella pertussis* | ATCC 9797 |
| *Clorobium tepidum* | ATCC 49652 |
| *Deinococcus radiodurans* | ATCC 13939 |
| *Clostridium acetobutylicum* | ATCC 824 |
| *Caulobacter crescentus* | ATCC 19089 |
| *Homo sapiens* | |
| *Vibrio fischeri* | ATCC 33715 |

-continued

List I

| | |
|---|---|
| *Agrobacterium tumefaciens* str. C58 (Cereon) | ATCC 33970 |
| *Ralstonia solanacearum* | ATCC 25237 |

ATCC: American Type Culture Collection, Rockville, MD, USA
PCC: Pasteur Culture Collection of Cyanobacteria. Paris France The metH-encoding sequence used according to the invention preferably comprises a coding sequence according to SEQ ID NO:1, 3, 5, 7, 9, 11, 13, 15, 17, 19, 21, 23, 25, 27, 29, 31, 33, 35, 37, 39, 41, 43, 45, 47, 49 and 51 or a nucleotide sequence homologous thereto which codes for a protein with metH activity.

Moreover, the metH-encoding sequence used according to the invention preferably codes for a protein with metH activity, said protein comprising an amino acid sequence according to SEQ ID NO:2, 4, 6, 8, 10, 12, 14, 16, 18, 20, 22, 24, 26, 28, 30, 32, 34, 36, 38, 40, 42, 44, 46, 48, 50 and 52 or an amino acid sequence homologous thereto which represents a protein with metH activity.

The coding metH sequence is preferably a DNA or an RNA which can be replicated in coryneform bacteria or is stably integrated into the chromosome.

According to a preferred embodiment, the method of the invention is carried out by
  a) using a bacterial strain transformed with a plasmid vector which carries at least one copy of the coding metH sequence under the control of regulatory sequences or
  b) using a strain in which the coding metH sequence has been integrated into the bacterial chromosome.

Furthermore, preference is given to overexpressing the coding metH sequence for the fermentation.

It may also be desirable to ferment bacteria in which additionally at least one further gene of the biosynthetic pathway of the desired sulfur-containing fine chemical or of a biosynthetic or other metabolic pathway associated therewith has been amplified; and/or in which at least one metabolic pathway, which reduces production of the desired sulfur-containing fine chemical has, at least partially, been switched off.

It may also be desirable to ferment bacteria in which additionally the activity of at least one further gene of the biosynthetic pathway of the desired sulfur-containing fine chemical is not undesirably influenced by metabolic metabolites.

Therefore, according to another embodiment of the method of the invention, coryneform bacteria are fermented in which, at the same time, at least one of the genes selected from among
  a) the aspartate kinase-encoding gene lysC,
  b) the aspartate-semialdehyde dehydrogenase-encoding gene asd,
  c) the glyceraldehyde-3-phosphate dehydrogenase-encoding gene gap,
  d) the 3-phosphoglycerate kinase-encoding gene pgk,
  e) the pyruvate carboxylase-encoding gene pyc,
  f) the triose phosphate isomerase-encoding gene tpi,
  g) the homoserine O-acetyltransferase-encoding gene metA,
  h) the cystathionine gamma-synthase-encoding gene metB,
  i) the cystathionine gamma-lyase-encoding gene metC,
  j) the serine hydroxymethyltransferase-encoding gene glyA,
  k) the O-acrylhomoserine sulfhydrylase-encoding gene metY,
  l) the methylene tetrahydrofolate reductase-encoding gene metF,
  m) the phosphoserine aminotransferase-encoding gene serC,
  n) the phosphoserine phosphatase-encoding gene serB,
  o) the serine acetyl transferase-encoding gene cysE,
  p) the homoserine dehydrogenase-encoding gene hom is overexpressed.

According to another embodiment of the method of the invention, coryneform bacteria are fermented in which, at the same time, at least one of the genes selected from among genes of the abovementioned group a) to p) is mutated in particular in such a way that the activity of the corresponding proteins is influenced by metabolic metabolites to a smaller extent, if at all, compared to nonmutated proteins and that in particular the inventive production of the fine chemical is not adversely affected. Owing to the mutation, the protein may also have higher activity (substrate conversion) and/or substrate specificity and thus enhance the production of the desired fine chemical.

According to another embodiment of the method of the invention, coryneform bacteria are fermented in which, at the same time, at least one of the genes selected from among
  q) the homoserine kinase-encoding gene thrB,
  r) the threonine dehydratase-encoding gene ilvA,
  s) the threonine synthase-encoding gene thrC,
  t) the meso-diaminopimelate D-dehydrogenase-encoding gene ddh,
  u) the phosphoenolpyruvate carboxykinase-encoding gene pck,
  v) the glucose-6-phosphate 6-isomerase-encoding gene pgi,
  w) the pyruvate oxidase-encoding gene poxB,
  x) the dihydrodipicolinate synthase-encoding gene dapA,
  y) the dihydrodipicolinate reductase-encoding gene dapB; or
  z) the diaminopicolinate decarboxylase-encoding gene lysA is attenuated, in particular by reducing the rate of expression of the corresponding gene, or by expressing a protein having lower activity (substrate conversion).

According to another embodiment of the method of the invention, coryneform bacteria are fermented in which, at the same time, at least one of the genes of the above groups q) to z) is mutated in such a way that the enzymic activity of the corresponding protein is partially or completely reduced.

Preference is given to using, in the method of the invention, microorganisms of the species *Corynebacterium glutamicum*.

In a further embodiment of the method, those microorganisms which are resistant to at least one methionine biosynthesis inhibitor are employed. Such inhibitors are methionine analogs such as α-methylmethionine, ethionine, norleucine, N-acetylnorleucine, S-trifluoromethylhomocysteine, 2-amino-5-heprenoic acid, selenomethionine, methionine-sulfoximine, methoxine and 1-aminocyclopentanecarboxylic acid.

The invention further relates to a method for producing an L-methionine-containing animal feed additive from fermentation broths, which comprises the following steps:
  a) culturing and fermentation of an L-methionine-producing microorganism in a fermentation medium;
  b) removal of water from the L-methionine-containing fermentation broth;
  c) removal of from 0 to 100% by weight of the biomass formed during fermentation; and d) drying of the fermentation broth obtained according to b) and/or c), in order to obtain the animal feed additive in the desired powder or granule form.

The invention likewise relates to the coding metH sequences isolated from the above microorganisms for the first time, to the methionine synthases encoded thereby and to the functional homologs of these polynucleotides and proteins, respectively.

In particular, the invention also relates to the expression constructs and microorganisms required for carrying out the above methods.

The invention therefore also relates to the following:

plasmid pCIS lysC thr311ile encoding lysC thr311ile or a functional equivalent thereof, i.e. a lysC mutant with comparable aspartate kinase activity which is increased over the wild type;

a host organism transformed with plasmid pCIS lysC thr311ile, in particular selected from among microorganisms of the genus *Corynebacterium,* in particular of the species *C. glutamicum,* such as transformed strain LU1479 lysC 311ile;

plasmid pC Phsdh metH Sc encoding *Streptomyces coelicolor* metH;

a host organism as defined above, transformed with a plasmid encoding exogenous metH; in particular transformed with the plasmid pC Phsdh metH Sc;

a host organism as defined above with resistance to at least one methionine biosynthesis inhibitor such as the transformed strain LU1479 lysC 311ile ET-16, optionally transformed with an exogenous coding metH sequence, such as the transformed strain LU1479 lysC311ile ET-16 pC Phsdh metH Sc.

DETAILED DESCRIPTION OF THE INVENTION a) General Terms

Proteins with the biological activity of methionine synthase, also metH for short (systematic name: 5-methyltetrahydrofolate homocysteines S-methyltransferase; EC 2.1.1.13), refer to those proteins which are capable of converting homocysteine to methionine and tetrahydrofolate using the cofactors 5-methyltetrahydrofolate (MTHF), cobalamin (vitamin B12) and S-adenosylmethionine. While the cofactor 5-methyltetrahydrofolate enters the reaction stoichiometrically (1 mol of MTHF/1 mol of methionine formed), S-adenosylmethionine is converted substoichiometrically as described in the literature. Cobalamin, on the other hand, is catalytically involved in the conversion. Further details of the metH protein are known to the skilled worker. (Banerjee R. V., Matthews R. G., FASEB J., 4:1450-1459, 1990, Ludwig M L., Matthews R G., Annual Review of Biochemistry. 66:269-313,1997, Drennan C L., Matthews R G., Ludwig M L., Current Opinion in Structural Biology. 4:919-29, 1994). The skilled worker distinguishes the activity of the cobalamin-dependent 5-methyltetrahydrofolate homocysteine S-methyltransferase from that of the cobalamin-independent 5-methyltetrahydropteroyltriglutamate homocysteine S-methyltransferase (EC 2.1.1.14), also known as metE. The skilled worker can detect the enzymic activity of metH using enzyme assays, protocols for which may be: Jarrett J T., Goulding C W., Fluhr K., Huang S., Matthews R G., Methods in Enzymology. 281:196-213, 1997.

Within the scope of the present invention, the term "sulfur-containing fine chemical" includes any chemical compound which contains at least one covalently bound sulfur atom and is accessible by a fermentation method of the invention. Non-limiting examples thereof are methionine, homocysteine, S-adenosylmethionine, in particular methionine and S-adenosylmethionine.

Within the scope of the present invention, the terms "L-methionine", "methionine", homocysteine and S-adenosylmethionine also include the corresponding salts such as, for example, methionine hydrochloride or methionine sulfate.

"Polynucleotides" in general refers to polyribonucleotides (RNA) and polydeoxyribonucleotides (DNA) which may be unmodified RNA and DNA respectively, or modified RNA and DNA, respectively.

According to the invention, "polypeptides" means peptides or proteins which contain two or more amino acids linked via peptide bonds.

The term "metabolic metabolite" refers to chemical compounds which occur in the metabolism of organisms as intermediates or else final products and which, apart from their property as chemical building blocks, may also have a modulating effect on enzymes and on their catalytic activity. It is known from the literature that such metabolic metabolites may act on the activity of enzymes in both an inhibiting and a stimulating manner (Biochemistry, Stryer, Lubert, 1995 W. H. Freeman & Company, New York, N.Y.). The possibility of producing in organisms enzymes in which the influence of metabolic metabolites has been modified by measures such as mutation of the genomic DNA by UV radiation, ionizing radiation or mutagenic substances and subsequent selection for particular phenotypes has also been described in the literature (Sahm H., Eggeling L., de Graaf A A., Biological Chemistry 381(9-10):899-910,2000; Eikmanns B J., Eggeling L., Sahm H., Antonie van Leeuwenhoek., 64:145-63, 1993-94). These altered properties may also be achieved by specific measurements. The skilled worker knows how to modify in enzyme genes specifically particular nucleotides of the DNA coding for the protein in such a way that the protein resulting from the expressed DNA sequence has certain new properties, for example that the modulating effect of metabolic metabolites on the unmodified protein has changed.

The activity of enzymes may be influenced in such a way that the reaction rate is reduced or the affinity for the substrate is modified or the reaction rates are changed.

The terms "express" and "amplification" or "overexpression" describe in the context of the invention the production of or increase in intracellular activity of one or more enzymes encoded by the corresponding DNA in a microorganism. For this purpose, for example, it is possible to introduce a gene into an organism, to replace an existing gene by another gene, to increase the copy number of the gene or genes, to use a strong promoter or to use a gene which codes for a corresponding enzyme having a high activity, and these measures can be combined, where appropriate.

b) metH Proteins of the Invention

The invention likewise includes "functional equivalents" of the specifically disclosed metH enzymes of organisms in the above list 1.

Within the scope of the present invention, "functional equivalents" or analogs of the specifically disclosed polypeptides are polypeptides different therefrom, which furthermore have the desired biological activity such as, for example, substrate specificity.

According to the invention, "functional equivalents" means in particular mutants which have in at least one of the abovementioned sequence positions an amino acid other than the specifically mentioned amino acid, but which have nevertheless one of the abovementioned biological activities. "Functional equivalents" thus also include the mutants obtainable by one or more amino acid additions, substitutions, deletions and/or inversions, it being possible for said modifications to occur at any position in the sequence as long as they result in a mutant having the property profile of the invention. There is functional equivalence in particular also when the reaction patterns of mutant and unmodified polypeptide match qualitatively, i.e. identical substrates are converted with different rates, for example.

"Functional equivalents" naturally also comprise polypeptides which are obtainable from other organisms, and naturally occurring variants. For example, homologous sequence regions can be found by sequence comparison, and equivalent enzymes can be established following the specific guidelines of the invention.

"Functional equivalents" likewise comprise fragments, preferably individual domains or sequence motifs, of the polypeptides of the invention, which have the desired biological function, for example.

"Functional equivalents" are also fusion proteins which have one of the abovementioned polypeptide sequences or functional equivalents derived therefrom and at least one further heterologous sequence functionally different therefrom in functional N— or C-terminal linkage (i.e. with negligible functional impairment of the functions of the fusion protein parts). Nonlimiting examples of such heterologous sequences are, for example, signal peptides, enzymes, immunoglobulins, surface antigens, receptors or receptor ligands.

According to the invention, "functional equivalents" include homologs of the specifically disclosed proteins. These have, for example over the entire length, at least 30%, or about 40%, 50%, preferably at least about 60%, 65%, 70%, or 75%, in particular at least 85%, such as, for example, 90%, 95% or 99%, homology to one of the specifically disclosed sequences, calculated by the algorithm of Pearson and Lipman, Proc. Natl. Acad., Sci. (USA) 85(8), 1988, 2444-2448. The degree of homology reflects in particular the degree of identity between modified and unmodified sequence.

Homologs of the proteins or polypeptides of the invention can be generated by mutagenesis, for example by point mutation or truncation of the protein. The term "homolog", as used herein, also relates to a variant form of the protein, which acts as agonist or antagonist of the protein activity.

Homologs of the proteins of the invention can be identified by screening combinatorial libraries of mutants such as, for example, truncation mutants. It is possible, for example, to generate a variegated library of protein variants by combinatory mutagenesis at the nucleic acid level, for example by enzymatic ligation of a mixture of synthetic oligonucleotides. There is a multiplicity of methods which can be used for preparing libraries of potential homologs from a degenerate oligonucleotide sequence. Chemical synthesis of a degenerate gene sequence can be carried out in an automatic DNA synthesizer, and the synthetic gene can then be ligated into a suitable expression vector. The use of a degenerate set of genes makes it possible to provide whole sequences which encode the desired set of potential protein sequences in one mixture. Methods for synthesizing degenerate oligonucleotides are known to the skilled worker (for example, Narang, S. A., (1983) Tetrahedron 39:3; Itakura et al., (1984) Annu. Rev. Biochem. 53:323; Itakura et al., (1984) Science 198: 1056; Ike et al., (1983) Nucleic Acids Res. 11:477).

In addition, libraries of fragments of the protein codon can be used to generate a variegated population of protein fragments for screening and for subsequent selection of homologs of a protein of the invention. In one embodiment, a library of coding sequence fragments can be generated by treating a double-stranded PCR fragment of a coding sequence with a nuclease under conditions under which nicking occurs only about once per molecule, denaturing the double-stranded DNA, renaturing the DNA to form double-stranded DNA which may comprise sense/antisense pairs of various nicked products, removing single-stranded sections from newly formed duplexes by treatment with S1 nuclease and ligating the resulting fragment library into an expression vector. It is possible by this method to devise an expression library which encodes N-terminal, C-terminal and internal fragments of the protein of the invention, which has different sizes.

Several techniques are known in the prior art for screening gene products from combinatorial libraries which have been produced by point mutations or truncation and for screening cDNA libraries for gene products with a selected property. These techniques can be adapted to rapid screening of gene libraries which have been generated by combinatorial mutagenesis of homologs of the invention. The most frequently used techniques for screening large gene libraries undergoing high-throughput analysis comprise the cloning of the gene library into replicable expression vectors, transformation of suitable cells with the resulting vector library and expression of the combinatorial genes under conditions under which detection of the desired activity facilitates isolation of the vector encoding the gene whose product has been detected. Recursive ensemble mutagenesis (REM), a technique which increases the frequency of functional mutants in the libraries, can be used in combination with the screening tests in order to identify homologs (Arkin und Yourvan (1992) PNAS 89:7811-7815; Delgrave et al. (1993) Protein Engineering 6(3):327-331 c) Polynucleotides of the Invention

The invention also relates to nucleic acid sequences (single- and double-stranded DNA and RNA sequences such as, for example cDNA and mRNA) coding for one of the above metH enzymes and the functional equivalents thereof which are obtainable, for example, also by use of artificial nucleotide analogs.

The invention relates both to isolated nucleic acid molecules which code for polypeptides or proteins of the invention or for biologically active sections thereof, and to nucleic acid fragments which can be used, for example, for use as hybridization probes or primers for identifying or amplifying coding nucleic acids of the invention.

Moreover, the nucleic acid molecules of the invention may contain untranslated sequences from the 3' and/or 5' ends of the coding region of the gene.

An "isolated" nucleic acid molecule is separated from other nucleic acid molecules which are present in the natural source of the nucleic acid and may moreover be essentially free of other cellular material or culture medium if it is prepared by recombinant techniques, or free of chemical precursors or other chemicals if it is chemically synthesized.

The invention furthermore comprises the nucleic acid molecules complementary to the specifically described nucleotide sequences or a section thereof.

The nucleotide sequences of the invention make it possible to generate probes and primers which can be used for identifying and/or cloning homologous sequences in other cell types and organisms. Such probes and primers usually complete a nucleotide sequence region which hybridizes under stringent conditions to at least about 12, preferably at least about 25, such as, for example 40, 50 or 75, consecutive nucleotides of a sense strand of a nucleic acid sequence of the invention or of a corresponding antisense strand.

Further nucleic acid sequences of the invention are derived from SEQ ID NO:1, 3, 5, 7, 9, 11, 13, 15, 17, 19, 21, 23, 25, 27, 29, 31, 33, 35, 37, 39, 41, 43, 45, 47, 49 or 51 and differ therefrom through addition, substitution, insertion or deletion of one or more nucleotides, but still code for polypeptides having the desired profile of properties. These may be polynucleotides which are identical to above sequences, for example over the entire length, in at least about 50%, 55%, 60%, 65%, 70%, 80% or 90%, preferably in at least about 95%, 96%, 97%, 98% or 99%, Of the sequence positions.

The invention also includes those nucleic acid sequences which comprise "silent" mutations or are modified, by comparison with a specifically mentioned sequence, in accordance with the codon usage of a specific source or host organism, as well as naturally occurring variants such as, for example, splice variants or allelic variants. The invention likewise relates to sequences which are obtainable by conservative nucleotide substitutions (i.e. the relevant amino acid is replaced by an amino acid of the same charge, size, polarity and/or solubility).

The invention also relates to molecules derived from specifically disclosed nucleic acids through sequence polymorphisms. These genetic polymorphisms may exist because of the natural variation between individuals within a population. These natural variations usually result in a variance of from 1 to 5% in the nucleotide sequence of a gene.

The invention furthermore also comprises nucleic acid sequences which hybridize with or are complementary to the abovementioned coding sequences. These polynucleotides can be found on screening of genomic or cDNA libraries, and where appropriate, be amplified therefrom by means of PCR using suitable primers, and then, for example, be isolated with suitable probes. Another possibility is to transform suitable microorganisms with polynucleotides or vectors of the invention, multiply the microorganisms and thus the polynucleotides, and then isolate them. An additional possibility is to synthesize polynucleotides of the invention by chemical routes.

The property of being able to "hybridize" to polynucleotides means the ability of a polynucleotide or oligonucleotide to bind under stringent conditions to an almost complementary sequence, while there are no unspecific bindings between noncomplementary partners under these conditions. For this purpose, the sequences should be 70-100%, preferably 90-100%, complementary. The property of complementary sequences being able to bind specifically to one another is made use of, for example, in the Northern or Southern blot technique or in PCR or RT-PCR in the case of primer binding. Oligonucleotides with a length of 30 base pairs or more are usually employed for this purpose. Stringent conditions means, for example, in the Northern blot technique the use of a washing solution at 50-70° C., preferably 60-65° C., for example 0.1×SSC buffer with 0.1% SDS (20×SSC; 3M NaCl, 0.3M Na citrate, pH 7.0) for eluting nonspecifically hybridized cDNA probes or oligonucleotides. In this case, as mentioned above, only nucleic acids with a high degree of complementarity remain bound to one another. The setting up of stringent conditions is known to the skilled worker and is described, for example, in Ausubel et al., Current Protocols in Molecular Biology, John Wiley & Sons, N.Y. (1989), 6.3.1-6.3.6. beschrieben.

c) Isolation of the Coding metH Gene

The metH genes coding for the enzyme methionine synthase (EC 2.1.1.13) can be isolated from the organisms of the above list I in a manner known per se.

In order to isolate the metH genes or else other genes of the organisms of the above list I first a gene library of this organism is generated in *Escherichia coli* (*E. coli*). The generation of gene libraries is described in detail in generally known textbooks and manuals. Examples which may be mentioned are the textbook by Winnacker: Gene und Klone, Eine Einführung in die Gentechnologie (Verlag Chemie, Weinheim, Germany, 1990), and the manual by Sambrook et al.: Molecular Cloning, A Laboratory Manual (Cold Spring Harbor Laboratory Press, 1989). A very well-known gene library is that of *E. coli* K-12 strain W3110, which was generated in λ vectors by Kohara et al. (Cell50, 495-508 (198).

In order to produce a gene library from organisms of list I in *E. coli*, cosmids such as the cosmid vector SuperCos I (Wahl et al., 1987, Proceedings of the National Academy of Sciences USA, 84: 2160-2164), or else plasmids such as pBR322 (BoliVal; Life Sciences, 25, 807-818 (1979)) or pUC9 (Vieira et al., 1982, Gene, 19: 259-268) can be used. Suitable hosts are in particular those *E. coli* strains which are restriction and recombination defective. An example of this is the strain DH5αmcr which has been described by Grant et al. (Proceedings of the National Academy of Sciences USA, 87 (1990) 4645-4649). The long DNA fragments cloned with the aid of cosmids may then in turn be subcloned into common vectors suitable for sequencing and subsequently be sequenced, as described, for example, in Sanger et al. (proceedings of the National Academy of Sciences of the United States of America, 74: 5463-5467, 1977).

The DNA sequences obtained can then be studied using known algorithms or sequence analysis programs such as, for example, those by Staden (Nucleic Acids Research 14, 217-232(1986)), by Marck (Nucleic Acids Research 16, 1829-1836 (1988)) or the GCG program by Butler (Methods of Biochemical Analysis 39, 74-97 (1998)).

The metH-encoding DNA sequences from organisms according to the above list I were found. In particular, DNA sequences according to SEQ ID NO:1, 3, 5, 7, 9, 11, 13, 15, 17, 19, 21, 23, 25, 27, 29, 31, 33, 35, 37, 39, 41, 43, 45, 47, 49 and 51 were found. Furthermore, the amino acid sequences of the corresponding proteins were derived from said DNA sequences present, using the above-described methods. SEQ ID NO:2, 4, 6, 8, 10, 12, 14, 16, 18, 20, 22, 24, 26, 28, 30, 32, 34, 36, 38, 40, 42, 44, 46, 48, 50 and 52 depict the resulting amino acid sequences of the metH gene products.

Coding DNA sequences which result from the sequences according to SEQ ID NO:1, 3, 5, 7, 9, 11, 13, 15, 17, 19, 21, 23, 25, 27, 29, 31, 33, 35, 37, 39, 41, 43, 45, 47, 49 and 51 due to the degeneracy of the genetic code are likewise subject of the invention. In the same way, the invention relates to DNA sequences which hybridize with said sequences or parts of sequences derived therefrom.

Instructions for identifying DNA sequences by means of hybridization can be found by the skilled worker, inter alia, in the manual "The DIG System Users Guide für Filter Hybridization" from Boehringer Mannheim GmbH (Mannheim, Germany, 1993) and in Liebi et al. (International Journal of Systematic Bacteriology (1991) 41: 255-260). Instructions for amplifying DNA sequences with the aid of the polymerase chain reaction (PCR) can be found by the skilled worker, inter alia, in the manual by Gait: Oligonucleotide synthesis: A Practical Approach (IRL Press, Oxford, UK, 1984) and in Newton and Graham: PCR (Spektrum Akademischer Verlag, Heidelberg, Germany, 1994).

It is furthermore known that changes at the N— and/or C-terminus of a protein do not substantially impair its function or may even stabilize said function. Information on this can be found by the skilled worker, inter alia, in Ben-Bassat et al. (Journal of Bacteriology 169: 751-757 (1987)), in O'Regan et al. (Gene 77: 237-251 (1989), in Sahin-Toth et al. (Protein Sciences 3: 240-247 (1994)), in Hochuli et al. (Biotechnology 6: 1321-1325 (1988)) and in known textbooks of genetics and molecular biology.

Amino acid sequences which result accordingly from SEQ ID NO:2, 4, 6, 8, 10, 12, 14, 16, 18, 20, 22, 24, 26, 28, 30, 32, 34, 36, 38, 40, 42, 44, 46, 48, 50 and 52 are likewise part of the invention.

d) Host Cells Used According to the Invention

The invention further relates to microorganisms serving as host cells, in particular coryneform bacteria, which contain a vector, in particular a shuttle vector or plasmid vector, carrying at least one metH gene as defined by the invention or in which a metH gene of the invention is expressed or amplified.

These microorganisms can produce sulfur-containing fine chemicals, in particular L-methionine, from glucose, sucrose, lactose, fructose, maltose, molasses, starch, cellulose or from glycerol and ethanol. Said microorganisms are preferably coryneform bacteria, in particular of the genus *Corynebacterium*. Of the genus *Corynebacterium*, mention must be made in particular of the species *Corynebacterium glutamicum* which is known in the art for its ability to produce L-amino acids.

Examples of suitable strains of coryneform bacteria, which may be mentioned, are those of the genus *Corynebacterium*, in particular of the species *Corynebacterium glutamicum* (*C. glutamicum*), such as

*Corynebacterium glutamicum* ATCC 13032,
*Corynebacterium acetoglutamicum* ATCC 15806,
*Corynebacterium acetoacidophilum* ATCC 13870,
*Corynebacterium thermoaminogenes* FERM BP-1539,
*Corynebacterium melassecola* ATCC 17965
or
of the genus *Brevibacterium*, such as
*Brevibacterium flavum* ATCC 14067
*Brevibacterium lactofermentum* ATCC 13869 and
*Brevibacterium divaricatum* ATCC 14020;
Or strains derived therefrom such as
*Corynebacterium glutamicum* KFCC10065
*Corynebacterium glutamicum* ATCC21608
which likewise produce the desired fine chemical or the precursor(s) thereof.

The abbreviation KFCC means the Korean Federation of Culture Collection, the abbreviation ATCC means the American Type Strain Culture Collection, and the abbreviation FERM means the collection of the National Institute of Bioscience and Human Technology, Agency of Industrial Science and Technology, Japan.

e) Carrying Out the Fermentation of the Invention

According to the invention, it was found that coryneform bacteria, after overexpression of a metH gene from organisms of the list I, produce sulfur-containing fine chemicals, in particular L-methionine, in an advantageous manner.

To achieve overexpression, the skilled worker can take different measures individually or in combination. Thus it is possible to increase the copy number of the appropriate genes or to mutate the promoter and regulatory region or the ribosomal binding site which is located upstream of the structural gene. Expression cassettes which are incorporated upstream of the structural gene act in the same way. Inducible promoters make it additionally possible to increase expression during the course of the fermentative L-methionine production. Expression is likewise improved by measures which extend the life span of the mRNA. Furthermore, the enzymic activity is likewise enhanced by preventing degradation of the enzyme protein. The genes or gene constructs may be either present in plasmids with varying copy number or integrated and amplified in the chromosome. A further possible alternative is to achieve overexpression of the relevant genes, by changing the media composition and management of the culture.

Instructions for this can be found by the skilled worker, inter alia, in Martin et al. (Biontechnology 5, 137-146 (1987)), in Guerrero et al. (Gene 138, 35-41 (1994)), Tsuchiya and Morinaga (Bio/Technology 6, 428-430 (1988)), in Eikmanns et al. (Gene 102, 93-98 (1991)), in the European patent 0472869, in U.S. Pat. No. 4,601,893, in Schwarzer and Pühler (Biotechnology 9, 84-87 (1991)), in Remscheid et al. (Applied and Environmental Microbiology 60, 126-132 (1994), in LaBarre et al. (Journal of Bacteriology 175, 1001-1007 (1993)), in the patent application WO 96/15246, in Malumbres et al. (Gene 134, 15-24 (1993)), in the Japanese published specification JP-A-10-229891, in Jensen und Hammer (Biotechnology and Bioengineering 58, 191-195 (1998)), in Makrides (Microbiological Reviews 60: 512-538 (1996) and in known textbooks of genetics and molecular biology.

The invention therefore also relates to expression constructs comprising a nucleic acid sequence coding for a polypeptide of the invention under the genetic control of regulatory nucleic acid sequences; and to vectors comprising at least one of said expression constructs. Such constructs of the invention preferably include a promoter 5' upstream of the particular coding sequence and a terminator sequence 3' downstream and also, where appropriate, further regulatory elements, in each case operatively linked to the coding sequence. An "operative linkage" means the sequential arrangement of promoter, coding sequence, terminator and, where appropriate, further regulatory elements such that each of the regulatory elements can properly carry out its function in the expression of the coding sequence. Examples of operatively linkable sequences are activating sequences and enhancers and the like. Further regulatory elements include selectable markers, amplification signals, origins of replication and the like. Suitable regulatory sequences are described, for example in Goeddel, Gene Expression Technology: Methods in Enzymology 185, Academic Press, San Diego, Calif. (1990).

In addition to the artificial regulatory sequences, the natural regulatory sequence may still be present upstream of the actual structural gene. Genetic modification can, where appropriate, switch off this natural regulation and increase or decrease expression of the genes. However, the gene construct may also have a simpler design, i.e. no additional regulatory signals are inserted upstream of the structural gene and the natural promoter with its regulation is not removed. Instead, the natural regulatory sequence is mutated such that regulation no longer takes place and gene expression is increased or reduced. The gene construct may contain one or more copies of the nucleic acid sequences.

Examples of useful promoters are: ddh, amy, lysC, dapA, lysA from *Corynebacterium glutamicum* promoters, but also Gram-positive promoters SPO2, as are described in *Bacillus Subtilis* and Its Closest Relatives, Sonenshein, Abraham L., Hoch, James A., Losick, Richard; ASM Press, District of Columbia, Washington and Patek M. Eikmanns B J., Patek J., Sahm H., Microbiology. 142 1297-309, 1996 or else the cos, tac, trp, tet, trp-tet, lpp, lac, lpp-lac, laclq, T7, T5, T3, gal, trc, ara, SP6, lambda-PR and lambda-PL promoters which are advantageously applied in Gram-negative bacteria. Preference is also give to using inducible promoters such as, for example light- and, in particular, temperature-inducible promoters such as the $P_rP_l$ promoter. It is in principle possible to use all natural promoters with their regulatory sequences. In addition, it is also possible to use advantageously synthetic promoters.

The regulatory sequences mentioned are intended to make specific expression of the nucleic acid sequences possible.

Depending on the host organism, this may mean, for example, that the gene is expressed or overexpressed only after induction, or that it is immediately expressed and/or overexpressed.

In this connection, the regulatory sequences and factors may preferably have a beneficial effect on, and thus increase or decrease, expression. Thus, it is possible and advantageous to enhance the regulatory elements at the transcriptional level by using strong transcription signals such as promoters and/or enhancers. However, it is also possible besides this to enhance translation by, for example, improving the stability of the mRNA.

An expression cassette is prepared by fusing a suitable promoter, a suitable Shine-Dalgamo sequence, to a metH nucleotide sequence and a suitable termination signal. For this purpose, common recombination and cloning techniques are used, such as those described, for example, in Current Protocols in Molecular Biology, 1993, John Wiley & Sons, Incorporated, New York, N.Y., PCR Methods, Gelfand, David H., Innis, Michael A., Sninsky, John J., 1999, Academic Press, Incorporated, Calif., San Diego, PCR Cloning Protocols, Methods in Molecular Biology Ser., Vol. 192, 2nd ed., Humana Press, N.J., Totowa. T. Maniatis, E. F. Fritsch and J. Sambrook, Molecular Cloning: A Laboratory Manual, Cold Spring Harbor Laboratory, Cold Spring Harbor, N.Y. (1989) and in T. J. Silhavy, M. L. Berman and L. W. Enquist, Experiments with Gene Fusions, Cold Spring Harbor Laboratory, Cold Spring Harbor, N.Y. (1984) and in Ausubel, F. M. et al., Current Protocols in Molecular Biology, Greene Publishing Assoc. and Wiley Interscience (1987).

The recombinant nucleic acid construct or gene construct is expressed in a suitable host organism by inserting it advantageously into a host-specific vector which makes optimal expression of the genes in the host possible. Vectors are well known to the skilled worker and can be found, for example, in "Cloning Vectors" (Pouwels P. H. et al., Hrsg, Elsevier, Amsterdam-New York-Oxford, 1985). The term "vectors" means, apart from plasmids, also all other vectors known to the skilled worker, such as, for example, phages, transposons, IS elements, plasmids, cosmids and linear or circular DNA. These vectors can replicate autonomously in the host organism or are replicated chromosomally. MetH genes of the invention were amplified by overexpressing them by way of example with the aid of episomal plasmids. Suitable plasmids are those which are replicated in coryneform bacteria. Numerous known plasmid vectors such as, for example, pZ1 (Menkel et al., Applied and Environmental Microbiology (1989) 64: 549-554), pEKEx1 (Eikmanns et al., Gene 102: 93-98 (1991)) or pHS2-1 (Sonnen et al., Gene 107: 69-74 (1991)) are based on the cryptic plasmids pHM1519, pBL1 or pGA1. Other plasmid vectors such as, for example, pCLiK5MCS, or those based on pCG4 (U.S. Pat. No. 4,489, 160) or pNG2 (Serwold-Davis et al., FEMS Microbiology Letters 66, 119-124 (1990)) or pAG1 (U.S. Pat. No. 5,158, 891) may be used in the same way.

Suitable plasmid vectors are furthermore also those with the aid of which it is possible to apply the method of gene amplification by integration into the chromosome, as has been described, for example, by Remscheid et al. (Applied and Environmental Microbiology 60, 126-132 (1994)) for the duplication and amplification of the hom-thrB operon. In this method, the complete gene is cloned into a plasmid vector which can replicate in a host (typically *E. coli*) but not in *C. glutamicum*. Suitable vectors are, for example, pSUP301 (Simon et al., Bio/Technology 1, 784-791 (1983)), pK18mob or pK19mob (Schäfer et al., Gene 145, 69-73 (1994)), Bernard et al., Journal of Molecular Biology, 234: 534-541 (1993)), pEM1 (Schrumpf et al., 1991, Journal of Bacteriology 173: 4510-4516) or pBGS8 (Spratt et al.,1986, Gene 41: 337-342). The plasmid vector containing the gene to be amplified is then transferred into the desired *C. glutamicum* strain via transformation. Methods for transformation are described, for example, in Thierbach et al. (Applied Microbiology and Biotechnology 29, 356-362 (1988)), Dunican and Shivnan (Biotechnology 7, 1067-1070 (1989)) and Tauch et al. (FEMS Microbiological Letters 123, 343-347 (1994)).

The activity of enzymes can be influenced by mutations in the corresponding genes in such a way that the rate of the enzymic reaction is partly or completely reduced. Examples of such mutations are known to the skilled worker (Motoyama H., Yano H., Terasaki Y., Anazawa H., Applied & Environmental Microbiology. 67:3064-70,2001, Eikmanns B J., Eggeling L., Sahm H., Antonie van Leeuwenhoek. 64:145-63, 1993-94.)

Additionally, it may be advantageous for the production of sulfur-containing fine chemicals, in particular L-methionine, to amplify, in addition to expression and amplification of a metH gene of the invention, one or more enzymes of the methionine biosynthetic pathway or of a biosynthetic or other metabolic pathway associated therewith (i.e. in functional connection therewith), such as of the cysteine, lysine or threonine metabolic pathway, such as in particular of aspartate-semialdehyde synthesis, of glycolysis, of anaplerosis, of the pentose phosphate metabolism, the citrate acid cycle or the amino acid export.

Thus, one or more of the following genes can be amplified to produce sulfur-containing fine chemicals, in particular L-methionine, (i.e. for example, be present with a higher copy number or encode an enzyme with higher activity or specificity):

the aspartate kinase-encoding gene lysC (EP 1 108 790 A2; DNA-SEQ NO.281), the aspartate-semialdehyde dehydrogenase-encoding gene asd (EP 1 108 790 A2; DNA-SEQ NO. 282), the glyceraldehyde-3-phosphate dehydrogenase-encoding gene gap (Eikmanns (1992), Journal of Bacteriology 174: 6076-6086), the 3-phosphoglycerate kinase-encoding gene pgk (Eikmanns (1992), Journal of Bacteriology 174: 6076-6086), the pyruvate carboxylase-encoding gene pyc (Eikmanns (1992), Journal of Bacteriology 174: 6076-6086), the triose phosphate isomerase-encoding gene tpi (Eikmanns (1992), Journal of Bacteriology 174: 6076-6086), the homoserine O-acetyltransferase-encoding gene metA (EP 1 108 790 A2; DNA-SEQ NO. 725), the cystathionine gamma-synthase-encoding gene metB (EP 1 108 790 A2; DNA-SEQ NO. 3491), the cystathionine gamma-lyase-encoding gene metC (EP 1 108 790 A2; DNA-SEQ NO. 3061), the serine hydroxymethyltransferase-encoding gene glyA (EP 1 108 790 A2; DNA-SEQ NO. 1110), the O-acetylhomoserine sulfhydrylase-encoding gene metY (EP 1 108 790 A2; DNA-SEQ NO. 726), the methylene tetrahydrofolate reductase-encoding gene metF (EP 1 108 790 A2; DNA-SEQ NO. 2379), the phosphoserine aminotransferase-encoding gene serC (EP 1 108 790 A2; DNA-SEQ NO. 928), a phosphoserine phosphatase-encoding gene serB (EP 1 108 790 A2; DNA-SEQ NO. 334, DNA-SEQ NO. 467, DNA-SEQ NO. 2767), the serine acetyl transferase-encoding gene cysE (EP 1 108 790 A2; DNA-SEQ NO. 2818), the homoserine dehydrogenase-encoding gene hom (EP 1 108 790 A2; DNA-SEQ NO. 1306)

Thus, it may be advantageous for the production of sulfur-containing fine chemicals, in particular L-methionine, in coryneform bacteria to mutate, at the same time, at least one of the genes below, in particular so that the activity of the corresponding proteins, compared to that of unmutated proteins, is influenced by a metabolic metabolite to a lesser extent or not at all:

the aspartate kinase-encoding gene lysC (EP 1 108 790 A2; DNA-SEQ NO. 281),
the pyruvate carboxylase-encoding gene pyc (Eikmanns (1992), Journal of Bacteriology 174: 6076-6086),
the homoserine O-acetyltransferase-encoding gene metA (EP 1 108 790 A2; DNA-SEQ NO. 725),
the cystathionine gamma-synthase-encoding gene metB (EP 1 108 790 A2; DNA-SEQ NO. 3491),
the cystathionine gamma-lyase-encoding gene metC (EP 1 108 790 A2; DNA-SEQ NO. 3061),
the serine hydroxymethyltransferase-encoding gene glyA (EP 1 108 790 A2; DNA-SEQ NO. 1110),
the 0-acetylhomoserine sulfhydrylase-encoding gene metY (EP 1 108 790 A2; DNA-SEQ NO. 726),
the methylene tetrahydrofolate reductase-encoding gene metF (EP 1 108 790 A2; DNA-SEQ NO. 2379),
the phosphoserine aminotransferase-encoding gene serC (EP 1 108 790 A2; DNA-SEQ NO. 928),
a phosphoserine phosphatase-encoding gene serB (EP 1 108 790 A2; DNA-SEQ NO. 334, DNA-SEQ NO. 467, DNA-SEQ NO. 2767),
the serine acetyl transferase-encoding gene cysE (EP 1 108 790 A2; DNA-SEQ NO. 2818),
the homoserine dehydrogenase-encoding gene hom (EP 1 108 790 A2; DNA-SEQ NO. 1306)

It may be furthermore advantageous for the production of sulfur-containing fine chemicals, in particular L-methionine, in addition to expression and amplification of one of the metH genes of the invention, to attenuate one or more of the following genes, in particular to reduce expression thereof, or to switch them off:

the homoserine kinase-encoding gene thrB (EP 1 108 790 A2; DNA-SEQ NO. 3453),
the threonine dehydratase-encoding gene ilvA (EP 1 108 790 A2; DNA-SEQ NO. 2328),
the threonine synthase-encoding gene thrC (EP 1 108 790 A2; DNA-SEQ NO. 3486),
the meso-diaminopimelate D-dehydrogenase-encoding gene ddh (EP 1 108 790 A2; DNA-SEQ NO. 3494),
the phosphoenolpyruvate carboxykinase-encoding gene pck (EP 1 108 790 A2; DNA-SEQ NO. 3157),
the glucose-6-phosphate 6-isomerase-encoding gene pgi (EP 1 108 790 A2; DNA-SEQ NO. 950),
the pyruvate oxidase-encoding gene poxB (EP 1 108 790 A2; DNA-SEQ NO. 2873),
the dihydrodipicolinate synthase-encoding gene dapA (EP 1 108 790 A2; DNA-SEQ NO. 3476),
the dihydrodipicolinate reductase-encoding gene dapB (EP 1 108 790 A2; DNA-SEQ NO. 3477)
the diaminopicolinate decarboxylase-encoding gene lysA (EP 1 108 790 A2; DNA-SEQ NO. 3451)

It may be furthermore advantageous for the production of sulfur-containing fine chemicals, in particular L-methionine, in coryneform bacteria to mutate, at the same time, at least one of the following genes in such a way that the enzymic activity of the corresponding protein is partly or completely reduced:

the homoserine kinase-encoding gene thrB (EP 1 108 790 A2; DNA-SEQ NO. 3453),
the threonine dehydratase-encoding gene ilvA (EP 1 108 790 A2; DNA-SEQ NO. 2328),
the threonine synthase-encoding gene thrC (EP 1 108 790 A2; DNA-SEQ NO. 3486),
the meso-diaminopimelate D-dehydrogenase-encoding gene ddh (EP 1 108 790 A2; DNA-SEQ NO. 3494),
the phosphoenolpyruvate carboxykinase-encoding gene pck (EP 1 108 790 A2; DNA-SEQ NO. 3157),
the glucose-6-phosphate 6-isomerase-encoding gene pgi (EP 1 108 790 A2; DNA-SEQ NO. 950),
the pyruvate oxidase-encoding gene poxB (EP 1 108 790 A2; DNA-SEQ NO. 2873),
the dihydrodipicolinate synthase-encoding gene dapA (EP 1 108 790 A2; DNA-SEQ NO. 3476),
the dihydrodipicolinate reductase-encoding gene dapB (EP 1 108 790 A2; DNA-SEQ NO. 3477)
the diaminopicolinate decarboxylase-encoding gene lysA (EP 1 108 790 A2; DNA-SEQ NO. 3451)

It may be furthermore advantageous for the production of sulfur-containing fine chemicals, in particular L-methionine, apart from expression and amplification of a metH gene of the invention, to eliminate unwanted secondary reactions which for example reduce the yield of fine chemicals (Nakayama: "Breeding of Amino Acid Producing Microorganisms", in: Overproduction of Microbial Products, Krumphanzl, Sikyta, Vanek (eds.), Academic Press, London, UK, 1982).

The microorganisms produced according to the invention may be cultured continuously or batchwise or in a fed batch or repeated fed batch process to produce sulfur-containing fine chemicals, in particular L-methionine. An overview of known cultivation methods can be found in the textbook by Chmiel (Bioprozeβtechnik 1. Einführung in die Bioverfahrenstechnik (Gustav Fischer Verlag, Stuttgart, 1991)) or in the textbook by Storhas (Bioreaktoren und periphere Einrichtungen (Vieweg Verlag, Braunschweig/Wiesbaden, 1994)).

The culture medium to be used must satisfy the demands of the particular strains in a suitable manner. The textbook "Manual of Methods für General Bacteriology" by the American Society for Bacteriology (Washington D.C., USA, 1981) contains descriptions of culture media for various microorganisms.

Said media which can be used according to the invention usually comprise one or more carbon sources, nitrogen sources, inorganic salts, vitamins and/or trace elements.

Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch and cellulose. Sugars may also be added to the media via complex compounds such as molasses or other byproducts of sugar refining. It may also be advantageous to add mixtures of different carbon sources. Other possible carbon sources are oils and fats such as, for example, soybean oil, sunflower oil, peanut oil and coconut fat, fatty acids such as, for example, palmitic acid, stearic acid and linoleic acid, alcohols such as, for example, glycerol, methanol and ethanol and organic acids such as, for example acetic acid and lactic acid.

Nitrogen sources are usually organic or inorganic hydrogen compounds or materials containing said compounds. Examples of nitrogen sources include ammonia gas or ammonium salts such as ammonium sulfate, ammonium chloride, ammonium phosphate, ammonium carbonate and ammonium nitrate, nitrates, urea, amino acids and complex nitrogen sources such as cornsteep liquor, soybean flour, soybean protein, yeast extract, meat extract and others. The nitrogen sources may be used singly or as mixture.

Inorganic salt compounds which may be included in the media comprise the chloride, phosphorus or sulfate salts of calcium, magnesium, sodium, cobalt, molybdenum, potassium, manganese, zinc, copper and iron.

Inorganic sulfur-containing compounds such as, for example, sulfates, sulfites, dithionites, tetrathionates, thiosulfates, sulfides, or else organic sulfur compounds such as mercaptans and thiols may be used as sources of sulfur for the production of sulfur-containing fine chemicals, in particular of methionine.

Phosphoric acid, potassium dihydrogen phosphate or dipotassium hydrogen phosphate or the corresponding sodium-containing salts may be used as sources of phosphorus.

Chelating agents may be added to the medium in order to keep the metal ions in solution. Particularly suitable chelating agents include dihydroxyphenols such as catechol or protocatechuate and organic acids such as citric acid.

The fermentation media used according to the invention usually also contain other growth factors such as vitamins or growth promoters, which include, for example, biotin, riboflavin, thiamine, folic acid, nicotinic acid, panthothenate and pyridoxine. Growth factors and salts are frequently derived from complex media components such as yeast extract, molasses, cornsteep liquor and the like. It is moreover possible to add suitable precursors to the culture medium. The exact composition of the media heavily depends on the particular experiment and is decided upon individually for each specific case. Information on the optimization of media can be found in the textbook "Applied Microbiol. Physiology, A Practical Approach" (Editors. P. M. Rhodes, P. F. Stanbury, IRL Press (1997) pp. 53-73, ISBN 0 19 963577 3). Growth media can also be obtained from commercial suppliers, for example Standard 1 (Merck) or BHI (brain heart infusion, DIFCO) and the like.

All media components are sterilized, either by heat (20 min at 1.5 bar and 121° C.) or by sterile filtration. The components may be sterilized either together or, if required, separately. All media components may be present at the start of the cultivation or added continuously or batchwise, as desired.

The culture temperature is normally between 15° C. and 45° C., preferably at from 25° C. to 40° C., and may be kept constant or may be altered during the experiment. The pH of the medium should be in the range from 5 to 8.5, preferably around 7.0. The pH for cultivation can be controlled during cultivation by adding basic compounds such as sodium hydroxide, potassium hydroxide, ammonia and aqueous ammonia or acidic compounds such as phosphoric acid or sulfuric acid. Foaming can be controlled by employing antifoams such as, for example, fatty acid polyglycol esters. To maintain the stability of plasmids it is possible to add to the medium suitable substances having a selective effect, for example antibiotics. Aerobic conditions are maintained by introducing oxygen or oxygen-containing gas mixtures such as, for example, air into the culture. The temperature of the culture is normally 20° C. to 45° C. The culture is continued until formation of the desired product is at a maximum. This aim is normally achieved within 10 to 160 hours.

The fermentation broths obtained in this way, in particular those containing L-methionine, usually contain a dry biomass of from 7.5 to 25% by weight.

An additional advantage is to carry out the fermentation under sugar limitation, at least at the end, but in particular over at least 30% of the fermentation period. This means that during this time the concentration of utilizable sugar in the fermentation medium is maintained at or reduced to $\geq 0$ to 3 g/l.

The fermentation broth is then processed further. The biomass may, according to requirement, be removed completely or partially from the fermentation broth by separation methods such as, for example, centrifugation, filtration, decanting or a combination of these methods or be left completely in said broth.

Subsequently, the fermentation broth may be thickened or concentrated using known methods such as, for example, with the aid of a rotary evaporator, thin film evaporator, falling film evaporator, by reverse osmosis, or by nanofiltration. This concentrated fermentation broth can then be worked up by freeze drying, spray drying, spray granulation or by other methods.

However, it is also possible to further purify the sulfur-containing fine chemicals, in particular L-methionine. To this end, the product-containing broth, after removing the biomass, is subjected to a chromatography using a suitable resin, the desired product or the contaminations being retained completely or partially on the chromatographic resin. These chromatographic steps can be repeated, if necessary, using the same or different chromatographic resin. The skilled worker is familiar with the selection of suitable chromatographic resins and their most effective application. The purified product can be concentrated by filtration or ultrafiltration and stored at a temperature at which the stability of the product is greatest.

The identity and purity of the isolated compound(s) can be determined by techniques of the art. These include high performance liquid chromatography (HPLC), spectroscopic methods, staining methods, thin-layer chromatography, NIRS, enzyme assay or microbiological assays. These analytic methods are summarized in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH: Weinheim, pp. 89-90, pp. 521-540, pp. 540-547, pp. 559-566, 575-581 and pp. 581-587; Michal, G., (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Volume 17.

The following nonlimiting examples describe the invention in more detail:

EXAMPLE 1

Construction of pCLiK5MCS

First, ampicillin resistance and origin of replication of the vector pBR322 were amplified using the oligonucleotides p1.3 (SEQ ID NO:53) and p2.3 (SEQ ID NO:54) with the aid of the polymerase chain reaction (PCR).

p1.3 (SEQ ID NO:53)
5'-CCCGGGATCCGCTAGCGGCGCGCCGGCC
GGC-
CCG-
GTGT-
GAAATACCGCACAG-3' p2.3 (SEQ ID NO:54)
5'-TCTAGACTCGAGCGGCCGCGGCCCGGCCT
TTAAATTGAAGACGAAAGGGCCTCG-3'

In addition to sequences complementary to pBR322, the oligonucleotide p1.3 (SEQ ID NO:53) contains in 5'-3' direction the cleavage sites for the restriction nucleases SmaI, BamHI, NheI and AscI and the oligonucleotide p2.3 (SEQ ID NO:54) contains in 5'-3' direction the cleavage sites for the restriction endonucleases XbaI, XhoI, NotI and DraI. The PCR reaction was carried out according to a standard method such as that by Innis et al. (PCR Protocols. A Guide to Methods and Applications, Academic Press (1990)) using Pfu-Turbo polymerase (Stratagene, La Jolla, USA). The DNA fragment obtained of approximately 2.1 kb in size was purified using the GFX™PCR, DNA and gel band purification kit (Amersham Pharmacia, Freiburg) according to the manufacturer's instructions. The blunt ends of the DNA fragment were ligated to one another using the rapid DNA ligation kit (Roche Diagnostics, Mannheim) according to the manufacturer's instructions and the ligation mixture was transformed into competent E. coli XL-1Blue (Stratagene, La Jolla, USA) according to standard methods, as described in Sambrook et al. (Molecular Cloning. A Laboratory Manual, Cold Spring Harbor, (1989)). Plasmid-carrying cells were selected for by plating out onto ampicillin (50 µg/ml)-containing LB agar (Lennox, 1955, Virology, 1:190).

The plasmid DNA of an individual clone was isolated using the Qiaprep spin miniprep kit (Qiagen, Hilden) according to the manufacturer's instructions and checked by restriction digests. The plasmid obtained in this way is denoted pCLiK1.

Starting from plasmid pWLT1 (Liebl et al., 1992) as template for a PCR reaction, a kanamycin resistance cassette was amplified using the oligonucleotides neo1 (SEQ ID NO:55) and neo2 (SEQ ID NO:56).

```
neo1 (SEQ ID NO:55):
5'-GAGATCTAGACCCGGGGATCCGCTAGCGGGCTGCTAAAG
GAAGCGGA-3' neo2 (SEQ ID NO:56):
5'-GAGAGGCGCGCCGCTAGCGTGGGCGAAGAACTCCAGCA-3'
```

Apart from the sequences complementary to pWLT1, the oligonucleotide neo1 contains in 5'-3' direction the cleavage sites for the restriction endonucleases XbaI, SmaI, BamHI, NheI and the oligonucleotide neo2 (SEQ ID NO:56) contains in 5'-3' direction the cleavage sites for the restriction endonucleases AscI and NheI. The PCR reaction was carried out using PfuTurbo polymerase (Stratagene, La Jolla, USA) according to a standard method such as that of Innis et al. (PCR Protocols. A Guide to Methods and Applications, Academic Press (1990)). The DNA fragment obtained was approximately 1.3 kb in size was purified using the GFX™PCR, DNA and gel band purification kit (Amersham Pharmacia, Freiburg) according to the manufacturer's instructions. The DNA fragment was cleaved with restriction endonucleases XbaI and AscI (New England Biolabs, Beverly, USA) and, following that, again purified using the GFX™PCR, DNA and gel band purification kit (Amersham Pharmacia, Freiburg) according to the manufacturer's instructions. The vector pCLiK1 was likewise cleaved with the restriction endonucleases XbaI and AscI and dephosphorylated using alkaline phosphatase (Roche Diagnostics, Mannheim) according to the manufacturer's instructions. After electrophoresis in a 0.8% strength agarose gel, the linearized vector (approx. 2.1 kb) was isolated using the GFX™PCR, DNA and gel band purification kit (Amersham Pharmacia, Freiburg) according to the manufacturer's instructions. This vector fragment was ligated with the cleaved PCR fragment with the aid of the rapid DNA ligation kit (Roche Diagnostics, Mannheim) according to the manufacturer's instructions and the ligation mixture was transformed into competent E. coli XL-1Blue (Stratagene, La Jolla, USA) according to standard methods, as described in Sambrook et al. (Molecular Cloning. A Laboratory Manual, Cold Spring Harbor, (1989)). Plasmid-carrying cells were selected for by plating out onto ampicillin (50 µg/ml)- and kanamycin (20 µg/ml)-containing LB agar (Lennox, 1955, Virology, 1:190).

The plasmid DNA of an individual clone was isolated using the Qiaprep spin miniprep kit (Qiagen, Hilden) according to the manufacturer's instructions and checked by restriction digests. The plasmid obtained in this way is denoted pCLiK2.

The vector pCLiK2 was cleaved with the restriction endonuclease DraI (New England Biolabs, Beverly, USA). After electrophoresis in 0.8% strength agarose gel, an approx. 2.3 kb vector fragment was isolated using the GFX™PCR, DNA and gel band purification kit (Amersham Pharmacia, Freiburg) according to the manufacturer's instructions. This vector fragment was religated with the aid of the rapid DNA ligation kit (Roche Diagnostics, Mannheim) according to the manufacturer's instructions and the ligation mixture was transformed into competent E. coli XL-1Blue (Stratagene, La Jolla, USA) according to standard methods, as described in Sambrook et al. (Molecular Cloning. A Laboratory Manual, Cold Spring Harbor, (1989)). Plasmid-carrying cells were selected for by plating out onto kanamycin (20 µg/ml)-containing LB agar (Lennox, 1955, Virology, 1:190).

The plasmid DNA of an individual clone was isolated using the Qiaprep spin miniprep kit (Qiagen, Hilden) according to the manufacturer's instructions and checked by restriction digests. The plasmid obtained in this way is denoted pCLiK3.

Starting from plasmid pWLQ2 (Liebl et al., 1992) as template for a PCR reaction, the origin of replication pHM1519 was amplified using the oligonucleotides cg1 (SEQ ID NO:57) and cg2 (SEQ ID NO:58).

```
cg1 (SEQ ID NO:57):
5'-GAGAGGGCGGCCGCGCAAAGTCCCGCTTCGTGAA-3' cg2 (SEQ ID NO:58):
5'-GAGAGGGCGGCCGCTCAAGTCGGTCAAGCCACGC-3'
```

Apart from the sequences complementary to pWLQ2, the oligonucleotides cg1 (SEQ ID NO:57) and cg2 (SEQ ID NO:58) contain cleavage sites for the restriction endonuclease NotI. The PCR reaction was carried out using Pfu-Turbo polymerase (Stratagene, La Jolla, USA) according to a standard method such as that of Innis et al. (PCR Protocols. A Guide to Methods and Applications, Academic Press (1990)). The DNA fragment obtained was approximately 2.7 kb in size and was purified using the GFX™PCR, DNA and gel band purification kit (Amersham Pharmacia, Freiburg) according to the manufacturer's instructions. The DNA fragment was cleaved with restriction endonuclease NotI (New England Biolabs, Beverly, USA) and, following that, again purified using the GFX™PCR, DNA and gel band purification kit (Amersham Pharmacia, Freiburg) according to the manufacturer's instructions. The vector pCLiK3 was likewise cleaved with the restriction endonuclease NotI and dephosphorylated using alkaline phosphatase (Roche Diagnostics, Mannheim) according to the manufacturer's instructions. After electrophoresis in a 0.8% strength agarose gel, the linearized vector (approx. 2.3 kb) was isolated using the GFX™PCR, DNA and gel band purification kit (Amersham Pharmacia, Freiburg) according to the manufacturer's instructions. This vector fragment was ligated with the cleaved PCR fragment with the aid of the rapid DNA ligation kit (Roche Diagnostics, Mannheim) according to the manufacturer's instructions and the ligation mixture was transformed into competent E. coli XL-1Blue (Stratagene, La Jolla, USA) according to standard methods, as described in Sambrook et al. (Molecular Cloning. A Laboratory Manual, Cold Spring Harbor, (1989)). Plasmid-carrying cells were selected for by plating out onto kanamycin (20 μg/ml)-containing LB agar (Lennox, 1955, Virology, 1:190).

The plasmid DNA of an individual clone was isolated using the Qiaprep spin miniprep kit (Qiagen, Hilden) according to the manufacturer's instructions and checked by restriction digests. The plasmid obtained in this way is denoted pCLiK5.

PCLik5 was extended by a multiple cloning site (MCS) by combining the two synthetic essentially complementary oligonucleotides HS445 ((SEQ ID NO:59) and HS446 (SEQ ID NO:60)) which contain cleavage sites for the restriction endonucleases SwaI, XhoI, AatI, ApaI, Asp718, MluI, NdeI, SpeI, EcoRV, SalI, ClaI, BamHI, XbaI and SmaI to give a double-stranded DNA fragment by heating them together to 95° C. followed by slow cooling.

```
HS445 (SEQ ID NO:59):
5'-TCGAATTTAAATCTCGAGAGGCCTGACGTCGGGCCCGGTACCACGCG
TCATATGACTAGTTCGGACCTAGGGATATCGTCGACATCGATGCTCTTCT
GCGTTAATTAACAATTGGGATCCTCTAGACCCGGGATTTAAAT-3'

HS446 (SEQ ID NO:60):
5'-GATCATTTAAATCCCGGGTCTAGAGGATCCCAATTGTTAATTAACGC
AGAAGAGCATCGATGTCGACGATATCCCTAGGTCCGAACTAGTCATATGA
CGCGTGGTACCGGGCCCGACGTCAGGCCTCTCGAGATTTAAAT-3'
```

The vector pCLiK5 was cleaved with the restriction endonucleases XhoI and BamHI (New England Biolabs, Beverly, USA) and dephosphorylated using alkaline phosphatase (I (Roche Diagnostics, Mannheim)) according to the manufacturer's instructions. After electrophoresis in a 0.8% strength agarose gel, the linearized vector (approx. 5.0 kb) was isolated using the GFX™PCR, DNA and gel band purification kit (Amersham Pharmacia, Freiburg) according to the manufacturer's instructions. This vector fragment was ligated with the synthetic double-stranded DNA fragment with the aid of the rapid DNA ligation kit (Roche Diagnostics, Mannheim) according to the manufacturer's instructions and the ligation mixture was transformed into competent E. coli XL-1Blue (Stratagene, La Jolla, USA) according to standard methods as described Sambrook et al. (Molecular Cloning. A Laboratory Manual, Cold Spring Harbor (1989)). Plasmid-carrying cells were selected for by plating out onto kanamycin (20 μg/ml)-containing LB agar (Lennox, 1955, Virology, 1:190).

The plasmid DNA of an individual clone was isolated using the Qiaprep spin miniprep kit (Qiagen, Hilden) according to the manufacturer's instructions and checked by restriction digests. The plasmid obtained in this way is denoted pCLiK5MCS.

Sequencing reactions were carried out according to Sanger et al. (1977) Proceedings of the National Academy of Sciences USA 74:5463-5467. The sequencing reactions were fractionated and analyzed by means of ABI Prism 377 (PE Applied Biosystems, Weiterstadt).

The resultant plasmid pCLiK5MCS is listed as SEQ ID NO: 63.

EXAMPLE 2

Construction of pCLiK5MCS Integrativ sacB

Starting from the plasmid pK19mob (Schäfer et al., Gene 145,69-73(1994)) as template for a PCR reaction, the Bacillus subtilis sacB gene (coding for levan sucrase) was amplified using the oligonucleotides BK1732 and BK1733.

```
BK1732 (SEQ ID NO:61):
5'-GAGAGCGGCCGCCGATCCTTTTTAACCCATCAC-3'

BK1733 (SEQ ID NO:62):
5'-AGGAGCGGCCGCCATCGGCATTTTCTTTTGCG-3'
```

Apart from the sequences complementary to pEK19mobsac, the oligonucleotides BK1732 and BK1733 contain cleavage sites for the restriction endonuclease NotI. The PCR reaction was carried out using PfuTurbo polymerase (Stratagene, La Jolla, USA) using a standard method like that of Innis et al. (PCR Protocols. A Guide to Methods and Applications, Academic Press (1990)). The DNA fragment obtained of approximately 1.9 kb in size was purified using the GFX™PCR, DNA and gel band purification kit (Amersham Pharmacia, Freiburg) according to the manufacturer's instructions. The DNA fragment was cleaved with the restriction endonuclease NotI (New England Biolabs, Beverly, USA) and, following that, again purified using the GFX™PCR, DNA and gel band purification kit (Amersham Pharmacia, Freiburg) according to the manufacturer's instructions.

The vector pCLiK5MCS (prepared according to example 1) was likewise cleaved with the restriction endonuclease NotI and dephosphorylated using alkali phosphatase (I (Roche Diagnostics, Mannheim)) according to the manufacturer's instructions. After electrophoresis in a 0.8% strength agarose gel, an approximately 2.4 kb in size vector fragment was isolated using the GFX™PCR, DNA and gel band purification kit (Amersham Pharmacia, Freiburg) according to the manufacturer's instructions. This vector fragment was ligated with the cleaved PCR fragment with the aid of the rapid DNA ligation kit (Roche Diagnostics, Mannheim) according to the manufacturer's instructions and the ligation mixture was transformed into competent E. coli XL-1Blue (Stratagene, La Jolla, USA) according to standard methods, as described in Sambrook et al. (Molecular Cloning. A Laboratory Manual, Cold Spring Harbor, (1989)). Plasmid-carrying cells were selected for by plating out onto kanamycin (20 μg/ml)-containing LB agar (Lennox, 1955, Virology, 1:190).

The plasmid DNA of an individual clone was isolated using the Qiaprep spin miniprep kit (Qiagen, Hilden) according to the manufacturer's instructions and checked by restriction digests. The plasmid obtained in this way is denoted pCLiK5MCS integrativ sacB.

Sequencing reactions were carried out according to Sanger et al. (1977) Proceedings of the National Academy of Sciences USA 74:5463-5467. The sequencing reactions were fractionated and analyzed by means of ABI Prism 377 (PE Applied Biosystems, Weiterstadt).

The resultant plasmid pCLiK5MCS integrativ sacB is listed as SEQ ID NO: 64.

It is possible to prepare in an analog manner further vectors which are suitable for the inventive expression or overproduction of metH genes.

Examples 3 to 8 hereinbelow describe the step-wise construction of an improved methionine-producing strain referred to as LU1479 lysC 311ile ET-16 pC Phsdh metH Sc.

EXAMPLE 3

Isolation of the LysC Gene from *C. glutamicum* Strain LU1479

An allelic exchange of the lysC wild-type gene encoding the enzyme aspartate kinase in *C. glutamicum* ATCC13032, hereinbelow referred to as LU1479, is intended to be carried out in the first step of stem construction. A nucleotide exchange is to be carried out in the LysC gene so that the amino acid Thr at position 311 is exchanged in the resulting protein for the amino acid Ile.

Starting from the LU1479 chromosomal DNA as template for a PCR reaction, amplification was performed with the oligonucleotide primers SEQ ID NO:65 and SEQ ID NO:66 lysC with the aid of the Pfu-Turbo PCR System (Stratagene USA), following the manufacturer's instructions. *C. glutamicum* ATCC 13032 chromosomal DNA was prepared following the method of Tauch et al. (1995) Plasmid 33:168-179 or Eikmanns et al. (1994) Microbiology 140:1817-1828. The amplified fragment is flanked by an SalI restriction cleavage at its 5' end and by an MluI restriction cleavage at its 3' end. Prior to cloning, the amplified fragment was digested by these two restriction enzymes and purified using GFX™PCR, DNA and Gel Band Purification Kit (Amersham Pharmacia, Freiburg).

```
SEQ ID NO:65
5'-GAGAGAGAGACGCGTCCCAGTGGCTGAGACGCATC-3'

SEQ ID NO:66
5'-CTCTCTCTGTCGACGAATTCAATCTTACGGCCTG-3'
```

The resulting polynucleotide was cloned into pCLIK5 MCS integrativ SacB (hereinbelow referred to as pCIS; SEQ ID NO:64 of Example 2) via the SalI and MluI reaction cleavages and transformed into *E. coli* XL-1blue. Selection for plasmid-bearing cells was achieved by plating on kanamycin (20μg/ml)-containing LB agar (Lennox, 1955, Virology, 1:190). The plasmid was isolated, and the expected nucleotide sequence was verified by sequencing. Preparation of the plasmid DNA was carried out by methods of, and using materials from, Quiagen. Sequencing reactions were carried out as described by Sanger et al. (1977) Proceedings of the National Academy of Sciences USA 74:5463-5467. The sequencing reactions were separated and evaluated by means of ABI Prism 377 (PE Applied Biosystems, Weiterstadt). The resultant plasmid pCIS lysC is listed as SEQ ID NO:77.

Sequence SEQ ID NO:77 comprises the following essential part-regions:

| Position | Type of sequence | Description |
|---|---|---|
| 155-1420 | CDS[1] | lysC |
| 1974-2765 | CDS | kanamycin resistance |
| 3032-3892 (complement)[2] | CDS | replication origin/*E. coli*/ plasmid pMB |

[1] coding sequence
[2] on complementary strain

EXAMPLE 4

Mutagenesis of the *C. glutamicum* LysC Gene

The directed mutagenesis of the *C. glutamicum* lysC gene (Example 3) was carried out using the QuickChange Kit (Stratagene/USA) following the manufacturer's instructions. The mutagenesis was carried out in plasmid pCIS lysC, SEQ ID NO:77. The following oligonucleotide primers were synthesized with the aid of the Quickchange method (Stratagene) for the exchange of thr311 for 311 ile:

```
SEQ ID NO:67
5'-CGGCACCACCGACATCATCTTCACCTGCCCTCGTTCCG-3'

SEQ ID NO:68
5'-CGGAACGAGGGCAGGTGAAGATGATGTCGGTGGTGCCG-3'
```

The use of these oligonucleotide primers in the Quickchange reaction brings about an exchange of the nucleotide in position 932 (C being replaced by T) (cf. SEQ ID NO:75) in the lysC gene and to an amino acid substitution in position 311 (Thr→Ile) (cf. SEQ ID NO:76) in the corresponding enzyme. The resulting amino acid exchange Thr311ile in the lysC gene was verified by sequencing following transformation into *E. coli* XL1-blue and plasmid preparation.

The plasmid was named pCIS lysC thr311ile and is listed as SEQ ID NO:78.

Sequence ID NO:78 comprises the following essential part-regions:

| Position | Type of sequence | Description |
|---|---|---|
| 155-1420 | CDS[1] | lysC mutated |
| 1974-2765 | CDS | kanamycin resistance |
| 3032-3892 (complement)[2] | CDS | replication origin/*E. coli*/ plasmid pMB |

[1] coding sequence
[2] on complementary strain

Plasmid pCIS lysC thr311ile was transformed into *C. glutamicum* LU1470 by means of electroporation as described by Liebl, et al. (1989) FEMS Microbiology Letters 53:299-303. Modifications of the protocol are described in DE-A-10046870. The chromosomal arrangement of the lysC locus of individual transformants was verified by standard methods using Southern blotting and hybridization as described by Sambrook et al. (1989), Molecular Cloning. A Laboratory Manual, Cold Spring Harbor. This was done to ensure that the transformants are transformants which have the transformed plasmid integrated at the lysC locus by homologous recombination. Such colonies were grown overnight in media without antibiotic and the cells were then plated onto sucrose CM agar medium (10% sucrose) and incubated for 24 hours at 30° C.

Since the sacB gene, which is present in the vector pCIS lysC thr311ile, converts sucrose into a toxic product, only those colonies which have the sacB gene deleted between the wild-type lysC gene and the mutated gene lysC thr311ile by a second homologous recombination step are capable of establishing growth. During the homologous recombination step, either the wild-type gene or the mutated gene may be deleted together with the sacB gene. If the sacB gene is removed together with the wild-type gene, a mutated transformant results.

Colonies with established growth were picked and studied for kanamycin-sensitive penotypes. Clones with the deleted SacB gene must simultaneously display kanamycin-sensitive growth behavior. Such Kan-sensitive clones were studied in a shake flask for their lysin productivity (see Example 6). For comparison, the untreated strain LU1479 was grown. Clones whose lysine production exceeds that of the control were selected, chromosomal DNA was obtained, and the matching region of the LysC gene was amplified by a PCR reaction and sequenced. Such a clone with the property of increased lysine synthesis and confirmed mutation in lysC at position 932 was referred to as LU1479 lysC 311ile).

EXAMPLE 5

Generation of Ethionine-Resistant *C. glutamicum* Strains

In the second step of stem construction, the resulting strain LU1479 lysC 311ile (Example 4) was treated in order to induce ethionine resistance (Kase, H. Nakayama K. Agr. Biol. Chem. 39 153-106 1975 L-methionine production by methionine analog-resistant mutants of *Corynebacterium glutamicum*): an overnight culture in BHI medium (Difco) was washed in citrate buffer (50 mM pH 5.5) and treated for 20 minutes at 30° C. with N-methylnitrosoguanidine (10 mg/ml in 50 mM citrate pH 5.5). After treatment with the chemical mutagen N-methylnitrosoguanidine, the cells were washed (citrate buffer 50 mM pH 5.5) and plated onto a medium composed of the following components, based on 500 ml: 10 g $(NH_4)_2SO_4$, 0.5 g $KH_2PO_4$, 0.5 g $K_2HPO_4$, 0.125 g $MgSO_4.7H_2O$, 21 g MOPS, 50 mg $CaCl_2$, 15 mg proteocatechuate, 0.5 mg biotin, 1 mg thiamine, 5 g/l D,L-ethionine (Sigma Chemicals Germany), pH 7.0. In addition, the medium comprised 0.5 ml of a micronutrient salt solution of: 10 g/l $FeSO_4.7H_2O$, 1 g/l $MnSO_4*H_2O$, 0.1 g/l $ZnSO_4*7H_2O$, 0.02 g/l $CuSO_4$, 0.002 g/l $NiCl_2*6H_2O$. All the salts were dissolved in 0.1 M HCl. The finished medium was filtered-sterilized, 40 ml of sterile 50% glucose solution was added, liquid sterile agar was added to a final concentration of 1.5% and the mixture was poured into culture dishes.

Cells which had undergone mutagenizing treatment were applied to plates containing the above-described medium and incubated for 3-7 days at 30° C. Resulting clones were isolated, isolated at least once on the selection medium and then tested for their methionine productivity in medium II in a shake flask (see Example 6).

EXAMPLE 6

Production of Methionine Using Strain LU1479 LysC 311ile ET-16

The strains generated in Example 5 were grown for 2 days at 30° C. on an agar plate containing CM medium.

CM agar:
10.0 g/l D-Glucose, 2.5 g/l NaCl, 2.0 g/l urea, 10.0 g/l Bacto-peptone (Difco), 5.0 g/l yeast extract (Difco), 5.0 g/l beef extract (Difco), 22.0 g/l agar (Difco), autoclaved (20 min., 121° C.)

The cells were subsequently scraped from the plate and resuspended in saline. For the main culture, 10 ml of medium II and 0.5 g of autoclaved $CaCO_3$ (Riedel de Haen) in a 100 ml Erlenmeyer flask were inoculated with the cell suspension to an OD600 nm of 1.5 and incubated for 72 hours at 30° C. on an orbital shaker at 200 rpm.

Medium II:

| | |
|---|---|
| 40 g/l | sucrose |
| 60 g/l | molasses (based on 100% sugar content) |
| 10 g/l | $(NH_4)_2SO_4$ |
| 0.4 g/l | $MgSO_4*7H_2O$ |
| 0.6 g/l | $KH_2PO_4$ |
| 0.3 mg/l | thiamine*HCl |
| 1 mg/l | biotin (from a 1 mg/ml filter-sterilized stock solution which had been brought to pH 8.0 with $NH_4OH$ |
| 2 mg/l | $FeSO_4$ |
| 2 mg/l | $MnSO_4$ | brought to pH 7.8 with $NH_4OH$ and autoclaved (121° C., 20 min). In addition, vitamin B12 (hydroxycobalamine, Sigma Chemicals) from a stock solution (200 μg/ml, filter-sterilized) is added to a final concentration of 100 μg/l.

Methionine formed, and other amino acids in the culture broth, was with the aid of the amino acid determination method from Agilent on an Agilent 1100 Series LC System HPLC. Derivatization with ortho-phthalaldehyde before the column separation allowed the quantification of the amino acids formed. The amino acid mixture was separated on a Hypersil AA column (Agilent).

Clones whose methionine productivity was at least twice as high as that of the original strain LU 1479 lysC 311ile were isolated. One such a clone was employed in the subsequent experiments and was named LU 1479 lysC 311ile ET-16.

EXAMPLE 7

Cloning metH from *Streptomyces coelicolor* and Cloning into Plasmid pCPhsdh metH Sc a) Chromosomal DNA was isolated from *Streptomyces coelicolor* strain ATCC BAA-471 (from the American Type Strain Culture Collection, (ATCC) Atlanta, USA, available under the catalog number BAA-471 D). *C. glutamicum* ATCC 13032 chromosomal DNA was prepared by the method of Tauch et al. (1995) Plasmid 33:168-179 or Eikmanns et al. (1994) Microbiology 140:1817-1828.

A DNA fragment of approx. 180 base pairs in length was amplified from the noncoding 5' region (promoter region) of homoserine dehydrogenase (HsDH) using the oligonucleotide primers SEQ ID NO:69 and SEQ ID NO:70, the *C. glutamicum* chromosomal DNA as template and Pfu Turbo polymerase (Stratagene) with the aid of the polymerase chain reaction (PCR) by standard methods, such as Innis et al. (1990) PCR Protocols. A Guide to Methods and Applications, Academic Press. The amplified fragment is flanked by an XhoI restriction cleavage site at its 5' end and, at its 3' end, by a homologous region introduced via the oligo and homologous to *Streptomyces coelicolor* metH.

SEQ ID NO:69
5'-GAGACTCGAGGGAAGGTGAATCGAATTTCGG-3'
and

SEQ ID NO:70
5'-GTCCCGGGGAGAACGCACGATTCTCCAAAAATAATCGC-3'

The resultant DNA fragment was purified with the GFX™PCR, DNA and Gel Band Purification Kit (Amersham Pharmacia, Freiburg) following the manufacturer's instructions.

b) Starting from the *Streptomyces coelicolor* chromosomal DNA as template for a PCR reaction, a fragment of MetH was amplified with the oligonucleotide primers SEQ ID NO:71 and SEQ ID NO:72 with the aid of the GC-RICH PCR Systems (Roche Diagnostics, Mannheim) following the manufacturer's instructions. The amplified fragment is flanked at its 5' end by a region introduced via the oligo and homologous to the *C. glutamicum* HsDH promoter region.

```
SEQ ID NO:71
5'-GAATCGTGCGTTCTCCCCGGGAC-3'
and

SEQ ID NO:72
5'-GTAGTTGACCGAGTTGATCACC-3'
```

The resulting approx. 1.4 kb DNA fragment was purified with the GFX™PCR, DNA and Gel Band Purification Kit (Amersham Pharmacia, Freiburg) following the manufacturer's instructions.

c) In a further PCR reaction, the two fragments obtained above are employed jointly as templates. Owing to the regions introduced with the oligonucleotide primers SEQ ID NO:71 and SEQ ID NO:70, which are homologous to the respective other fragment, the two fragments anneal with each other during the PCR reaction and, owing to the polymerase employed, extend to form a continuous DNA strand. The standard method was modified in such a way that the oligonucleotide primers used, SEQ ID NO:69 and SEQ ID NO:72, were only added to the reaction mixture at the beginning of the 2nd cycle.

The amplified, approximately 1.6 kb DNA fragment was purified with the GFX™PCR, DNA and Gel Band Purification Kit following the manufacturer's instructions. Thereafter, it was cleaved with the restriction enzymes XhoI and NotI (Roche Diagnostics, Mannheim) and separated by gel electrophoresis. The approx. 1.6 kb DNA fragment was subsequently isolated from the agarose using the GFX™PCR, DNA and Gel Band Purification Kit (Amersham Pharmacia, Freiburg).

d) The metH 3' region, which was still missing, was amplified starting from the *Streptomyces coelicolor* chromosomal DNA as template using the oligonucleotide primers SEQ ID NO:73 and SEQ ID NO:74 with the aid of the GC-RICH PCR system (Roche Diagnostics, Mannheim) following the manufacturer's instructions. The amplified fragment is flanked at its 3' end by an EcoRV restriction cleavage site introduced via the oligo.

```
SEQ ID NO:73
5'-CCGGCCTGGAGAAGCTCG-3'
and

SEQ ID NO:74
5'-GAGAGATATCCCTCAGCGGGCGTTGAAG-3'
```

The resultant, approx. 2.2 kb DNA fragment was purified with the GFX™PCR, DNA and Gel Band Purification Kit (Amersham Pharmacia, Freiburg) following the manufacturer's instructions. Thereafter, it was cleaved with the restriction enzymes NotI and EcoRV (Roche Diagnostics, Mannheim) and separated by gel electrophoresis. The approx. 2.2 kb DNA fragment was subsequently isolated from the agarose using the GFX™PCR, DNA and Gel Band Purification Kit (Amersham Pharmacia, Freiburg).

e) The vector pClik5MCS SEQ ID NO:63 (Example 1) was cleaved with the restriction enzymes XhoI and EcoRV (Roche Diagnostics, Mannheim), and a 5 kb fragment was isolated following separation by electrophoresis, using the GFX™PCR, DNA and Gel Band Purification kit.

The vector fragment together with the two cleaved and purified PCR fragments were ligated with the aid of the Rapid DNA Ligation kit (Roche Diagnostics, Mannheim) following the manufacturer's instructions and the ligation reaction was transformed into competent *E. coli* XL-1Blue (Stratagene, La Jolla, USA) as described by Sambrook et al. (Molecular Cloning. A Laboratory Manual, Cold Spring Harbor, (1989)). Selection for plasmid-bearing cells was achieved by plating on kanamycin (20 µg/ml)-containing LB agar (Lennox, 1955, Virology, 1:190).

The plasmid DNA was prepared by methods of, and using materials from, Quiagen. Sequencing reactions were carried out as described by Sanger et al. (1977) Proceedings of the National Academy of Sciences USA 74:5463-5467. The sequencing reactions were separated and evaluated by means of ABI Prism 377 (PE Applied Biosystems, Weiterstadt).

The resultant plasmid pC Phsdh metH Sc (*Streptomyces coelicolor*) is listed as SEQ ID NO:79.

Sequence SEQ ID NO:79 comprises the following essential part-regions:

| Position | Type of sequence | Description |
|---|---|---|
| 6-155 | Promoter | HsDH |
| 156-3752 | CDS[1] | MetH *S. coelicolor* |
| 4153-4944 | CDS | Kanamycin resistance |
| 5211-6071 (complement)[2] | CDS | replication origin *E. coli*/Plasmid pMB |

[1] coding sequence
[2] on complementary strain

EXAMPLE 8

Transformation of Strain LU1479 LysC 311ile ET-16 with the Plasmid pC Phsdh metH Sc Strain LU1479 lysC 311ile ET-16 (Example 5) was transformed with the plasmid pC Phsdh metH Sc (Example 7) by the method described (Liebl, et al. (1989) FEMS Microbiology Letters 53:299-303). The transformation mix was plated onto CM plates supplemented with 20 mg/l kanamycin in order to achieve selection for plasmid-containing cells. Resultant Kan-resistant clones were picked and isolated. The methionine productivity of the clones was studied in a shake-flask experiment (see Example 6). Strain LU1479 lysC 311ile ET-16 pC Phsdh metH Sc produced significantly more methionine in comparison with LU1479 lysC 311 ile ET-16.

SEQUENCE LISTING (79 sequences)

SEQ ID NO: 1 - DNA, 3597 bp, Streptomyces coelicolor
  CDS (1)..(3594): RSX14254
gtgcgttctccccgggacgtcccacgacgggcggcaccgggcagaggcaaagccgacagccgtcgcatcctagggagccctttcatggcctcgtcgccatccaccccgcccgccgacacccgcacccgcgtgtccgccctccgagaggccctcgccacccgcgtggtggtcgccgacggcgccatgggcaccatgctccaggcccagaaccccacgctggacgacttccagcagctcgaagggtgcaacgaggtcctgaacctcacccggcccgacatcgtccgctcggtgcacgaggagtacttcgcggccggcgtcgactgcgtcgagaccaacaccttcggcgccaaccactccgccctgggcgagtacgacatccccgagcgcgtccacgaactgtccgaggccggcgcccgcgtcgcccgcgaggtcgccgacgagttcggcgcccgcgacggccggcagcgctgggtgctgggctccatgggccccggcaccaagctccccaccctcggccacgccccgtacaccgtcctgcgcgacgcctaccagcgcaacgccgagggactggtcgcgggcggcgcggacgcactgctggtggagaccacgcaggacctgctccagaccaaggcctcggtgctcggcgcccggcgcgccctggacgtcctcggcctcgacctgccgctcatcgtgtccgtcaccgtcgagaccaccggcaccatgctgctcggctcggagatcggcgccgcgctcaccgcgctggaaccgctcggcatcgacatgatcggcctgaactgcgccaccggccccgccgagatgagcgagcacctgcgctacctcgcccggcactcccgcatcccgctgacctgcatgcccaacgccggtctgcccgtcctcggcaaggacggcgcccactacccgctgaccgcgcccgagctggccgacgcacacgagaccttcgtgcgcgagtacggcctgtccctggtcggcggctgctgcggcaccacgcccgagcacctgcgccaggtcgtcgagcgggtccgggacaccgcccccaccgcacgcgacccgcgccccgagcccggcgccgcctcgctctaccagaccgtgcccttccgccaggacacctcctacctggccatcggcgagcgcaccaacgccaacgggtccaagaagttccgcgaggccatgctggacggccgctgggacgactgcgtcgagatggcccgcgaccagatccgcgaaggcgcgcacatgctcgacctctgcgtcgactacgtcggccgggacggcgtcgccgacatggaggaactggccggccggttcgccaccgcctccacgctgccgatcgtcctcgactccaccgaggtcgacgtcatccgggccggcctggagaagctcggcggccgcgcggtgatcaactcggtcaactacgaggacggcgccggccccgagtcccggttcgcccgcgtcacgaagctcgcccgggagcacggcgccgcgctgatcgcgctgaccatcgacgaggtgggacaggcccgcaccgccgagaagaaggtcgagatcgccgaacggctcatcgacgacctcaccggcaactggggcatccacgagtccgacatcctcgtcgactgcctgaccttcaccatctgcaccggccaggaggagtcccgcaaggacggcctggccaccatcgagggcatccgggaactcaagcggcgccacccggacgtgcagaccacgctcggcctgtcgaacatctccttcggcctcaacccggccgcccgcatcctgctcaactccgtcttcctcgacgaatgcgtcaaggccggcctggactcggccatcgtgcacgcgagcaagatcctgccgatcgcccgcttcgacgaggagcaggtcaccaccgccctcgacttgatctacgaccgccgccgcgagggctacgaccccctgcaaaagctcatgcagctcttcgagggcgccaccgccaagtcgctgaaggcctccaaggccgaggaactggccgccctcccgctggaggagcgcctcaagcgccgcatcatcgacggcgagaagaacggcctcgaacaggacctcgacgaggccctccgggagcgcccggccctcgagatcgtcaacgacaccctgctcgacggtatgaaggtcgtcggcgagctgttcggctccggccagatgcagctgccgttcgtgctccagtccgccgaggtcatgaagaccgcggtggcccacctggagccgcacatggagaagaccgacgacgacggcaagggcacgatcgtgctggccaccgtccgcggcgacgtccacgacatcggcaagaacctcgtcgacatcatcctgtccaacaacggctacaacgtcgtcaacctcggcatcaagcagcccgtctccgcgatcctggaagcggccgacgagcaccgggccgacgtcatcggcatgtccggcctcctcgtcaagtccacggtgatcatgaaggagaacctggaggagctgaaccagcgcaagctggccgccgactacccggtcatcctcggcggcgccgccctcaccagggcctacgtcgaacaggacctgcacgagatctacgacggcgaggtccgctacgcccgcgacgccttcgagggcctgcgcctcatggacgccctcatcggcatcaagcgcggcgtgcccggcgccaagctgccggagctgaagcagcgccgggtgcgggccgccaccgtcgagatcgacgagcgccccgaggaaggccacgtccgctccgacgtcgccaccgacaacccggtcccgaccccgcccttccgcggcacccgcgtcgtcaagggcatccagctcaaggagtacgcctcctggctcgacgagggcgccctcttcaagggccagtggggcctcaagcaggcccgcaccggcgagggaccctcctacgaggaactggtcgagtccgagggccggccgcggctgcgcggcctgctcgaccggctccagacggacaaccttttggaggcggccgtggtctacggctacttcccctgcgtctccaaggacgacgacctgatcgtcctcgacgacgacggcaacgaacgcacccgcttcaccttcccccgccagcgccgcggccggcgcctgtgcctggccgacttcttccgcccggaggagtccggcgagaccgacgtggtcggcttccaggtcgtcaccgtcggctcccgcatcggcgaggagacggcccgcatgttcgaggccaacgcctaccgcgactatctcgagctgcacggcctgtccgtgcagctcgccgaggccctcgccgagtactggcacgcgcgcgtgcgctcggaactcggcttcgccggggaggacccggccgagatggaggacatgttcgccctgaagtaccggggtgcccgcttctccctcggctacggcgcctgccccgacctggaggaccgcgccaagatcgccgccctgctggagcccgagcgcatcggcgtccacctatccgaggagttccagctccaccccgagcagtccaccgacgccatcgtcatccaccacccggaggccaagtacttcaacgcccgctga

SEQ ID NO: 2 - protein, 1198 aa, Streptomyces coelicolor
VRSPRDVPRRAAPGRGKADSRRILGSPFMASSPSTPPADTRTRVSALREALATRVVVADGAMGTMLQAQNPTLDDFQQLEGCNEVLNLTRPDIVRSVHEEYFAAGVDCVETNTFGANHSALGEYDIPERVHELSEAGARVAREVADEFGARDGRQRWVLGSMGPGTKLPTLGHAPYTVLRDAYQRNAEGLVAGGADALLVETTQDLLQTKASVLGARRALDVLGLDLPLIVSVTVETTGTMLLGSEIGAALTALEPLGIDMIGLNCATGPAEMSEHLRYLARHSRIPLTCMPNAGLPVLGKDGAHYPLTAPELADAHETFVREYGLSLVGGCCGTTPEHLRQVVERVRDTAPTARDPRPEPGAASLYQTVPFRQDTSYLAIGERTNANGSKKFREAMLDGRWDDCVEMARDQIREGAHMLDLCVDYVGRDGVADMEELAGRFATASTLPIVLDSTEVDVIRAGLEKLGGRAVINSVNYEDGAGPESRFARVTKLAREHGAALIALTIDEVGQARTAEKKVEIAERLIDDLTGNWGIHESDILVDCLTFTICTGQEESRKDGLATIEGIRELKRRHPDVQTTLGLSNISFGLNPAARILLNSVFLDECVKAGLDSAIVHASKILPIARFDEEQVTTALDLIYDRRREGYDPLQKLMQLFEGATAKSLKASKAEELAALPLEERLKRRIIDGEKNGLEQDLDEALRERPALEIVNDTLLDGMKVVGELFGSGQMQLPFVLQSAEVMKTAVAHLEPHMEKTDDDGKGTIVLATVRGDVHDIGKNLVDIILSNNGYNVVNLGIKQPVSAILEAADEHRADVIGMSGLLVKSTVIMKENLEELNQRKLAADYPVILGGAALTRAYVEQDLHEIYDGEVRYARDAFEGLRLMDALIGIKRGVPGAKLPELKQRRVRAATVEIDERPEEGHVRSDVATDNPVPTPPFRGTRVVKGIQLKEYASWLDEGALFKGQWGLKQARTGEGPSYEELVESEGRPRLRGLLDRLQTDNLLEAAVVYGYFPCVSKDDDLIVLDDDGNERTRFTFPRQRRGRRLCLADFFRPEESGETDVVGFQVVTVGSRIGEETARMFEANAYRDYLELHGLSVQLAEALAEYWHARVRSELGFAGEDPAEMEDMFALKYRGARFSLGYGACPDLEDRAKIAALLEPERIGVHLSEEFQLHPEQSTDAIVIHHPEAKYFNAR

SEQ ID NO: 3 - DNA, 3537 bp, Anabaena sp.
  CDS (1)..(3534): RAN03790
atgactcatcctttcctgaaacgcctgcacagtccggaacttccggttatcgtcttcgacggtgcaatgggaactaacctacaaacccaaaacctcacggctgaggatttcggcggtgtgcagtatgaaggttgtaacgaatacctagtccacaccaaacccgaagctgtcgccaaggttcaccgcgactttctcgctgtgggtgcagatgtcatcgaaaccgacactttcggtgcgacatccattgttttggcggaatatgacttagcagaccaaacatattacctgaacaagaaagccgccgaactggcgaaaagtgtcgctgctgaattttccacaccagataaaccccggtttgttgctggttccatcggccccacaaccaaacttcccaccttgggacatatcgactttgacactctcaaaacttgctttgctgaacaagcagaagcgctgttagatggtggcgtggatttacttttggtggagacttgtcaagatgtgctgcaaatcaaagcggcgctgaatgggatagaagaagtctttggcaagagaggggaacgcatacccttgatggtgtccgtgacaatggaaagcatggggacaatgttggtcggttccgaaatcaacgccgtcctgacaattttagaacctttcccaattgacattctcggtctgaactgtgccacaggcccagacttgatgaaaccacatattaaatatttggctgaacattcgccgtttgtggtttcttgtattcctaacgcgggtttaccagaaaacgttggtggtcaagcacattatcgcttaacaccaatggaattacgcatggcgttgatgcactttgttgaagatttgggtgtccaagtgatcgggggttgctgtgggacacgtccagaacacattcaacaattagcagaaattgccaaggatttaaagccaaaggtgagacagccaagtttagaacctgcggctgcatcaatatatagtactcaaccctacgaacaagataattctttcttgattgtgggtgaacgcctcaacgccagtggttccaagaaatgccgtgatttgctgaatgcggaagattgggacggattggtatcaatggcgcgatcgcaagtcaaggaaggcgcacatatccttgatgtcaacgttgattatgtgggacgggacggtgtgcgggatatgcacgaactagtttcccgcattgtgaataatgttacactccccttaatgctcgactccaccgaatgggaaaagatggaggcgggtttaaaggtggctggtggtaagtgtttgctgaactccaccaactacgaagatggggaaccacgtttcttaaaagtgttggagttggcgaagaaatatggcgcgggtgttgttattggcacaattgacgaagaagggatggcgcggacagccgagaaaaagtttcaaattgcccagcgtgcctatcgtcaatcggtagaatatgggattccccccacagaaatattctttgataccttagctttaccaatttctaccgggattgaagaagaccgggaaaatggcaaggcgacaattgaatcaattagccgtatccgtaaagaattgccagggtgtcatgttattttaggcgtgtcaaatatatcctttggcttaaattcagcctcgcggatggtcttaaactccgtgtttctccatgaagcaatgactgctggcatggatgcggcgatcgtcagtgctagcaagattctaccactgtcgaagattgaagagcgtcatcaagaagtctgccgccagttaatttatgaccagcgtaaatttgagggtgatatctgcatctatgaccccttaacagaactaactaaattgtttgagggagtcaccaccaaacgtaacaaaggcgttgatgaaagcttacccatcgaagaacgactcaagcgtcacattatcgacggcgaacgcattggtttagaagcgcaactgacaaaagccttagaacaatatccacccctagaaattatcaacactttcctactagatgggatgaaagtagtcggggaattgttcggttcaggacaaatgcagctacctttcgttttacagtcagccgaaaccatgaaagcggcggtagcctacctagaaccgttcatggaaaaatcggaaagtggcaacaatgccaaaggtaaagtaattattgccaccgtgaaaggcgatgttcacgacattggtaaaaacctagtagacattatcttgtccaacaacggctacaaggtaattaacctgggaattaaacagccggtggaaaatatcatcgaggcttacaaccaacacaaagctgattgtattgccatgagtggcttgctggtaaaatccaccgcattcatgaaagaaaatttggaggtcttcaacgaaaaaggcattaatgttcctgtaattttaggtggtgcggcattaaccccgaaattcgtgcataaagattgccaaaatacctacaaaggtaaagtcatttatggcaaagatgctttctcagacctgcatttcatggataaattaatgccagccaaagccactggcaaatgggacaattccttaggattcttggatgaagtagaaaccgaggaaacagaacctaccaatcacaaatccccaatccccagtccccaatccccagtccccagtccccagtccccagtccctatagacacccgacgttccgaagctgtagccatagacattccccgtcccacaccaccattctggggaacgcaattattacagcctagcgatatttccttagaggaaatattctggcacatggatttgcaagccttgattgcgggacaatggcaattccgcaaacccaaagaacaatcaaaggaagaatatcaagctttcttgaatgagaaagtgtatccagttctagaaacttggaaacagcgcatcattgcagaaaacttgttacatccccaggtaatttatgggtattttccttgtcaatctgagggtaatactttatatgtttacgaaacaaacagcccaaatgccacagaaatcactcagtttgaattcccccgacaaaagtcatcaaaacgattatgtattgccgatttctttgcaccgaaagattcaggaatcattgatgtcttccccatgcaggcggtgactgtaggcgaaattgctacagagttcgcgcaaaaattgtttgcaaacaatcaatacactgattatctgtattttcacggtttggcggtgcaagtagcagaagccttggccgagtggacacacgccagaatccgccgtgagttagggttcggtgctgaagaaccggataatatccgggatattttggcacaacgctatcagggttcccggtatagttttggctacccagcttgtcccaatattcaagaccagtttaagcagctggatttgttggagactagcagaattaacttatacatggatgaaagtgagcaactttatccagaacagtctacgacggcgattattacttatcacccagtagctaagtacttcaccgcgtaa

SEQ ID NO: 4 - protein, 1178 aa, Anabaena sp.
MTHPFLKRLHSPELPVIVFDGAMGTNLQTQNLTAEDFGGVQYEGCNEYLVHTKPEAVAKVHRDFLAVGADVIETDTFGATSIVLAEYDLADQTYYLNKKAAELAKSVAAEFSTPDKPRFVAGSIGPTTKLPTLGHIDFDTLKTCFAEQAEALLDGGVDLLLVETCQDVLQIKAALNGIEEVFGKRGERIPLMVSVTMESMGTMLVGSEINAVLTILEPFPIDILGLNCATGPDLMKPHIKYLAEHSPFVVSCIPNAGLPENVGGQAHYRLTPMELRMALMHFVEDLGVQVIGGCCGTRPEHIQQLAEIAKDLKPKVRQPSLEPAAASIYSTQPYEQDNSFLIVGERLNASGSKKCRDLLNAEDWDGLVSMARSQVKEGAHILDVNVDYVGRDGVRDMHELVSRIVNNVTLPLMLDSTEWEKMEAGLKVAGGKCLLNSTNYEDGEPRFLKVLELAKKYGAGVVIGTIDEEGMARTAEKKFQIAQRAYRQSVEYGIPPTEIFFDTLALPISTGIEEDRENGKATIESISRIRKELPGCHVILGVSNISFGLNSASRMVLNSVFLHEAMTAGMDAAIVSASKILPLSKIEERHQEVCRQLIYDQRKFEGDICIYDPLTELTKLFEGVTTKRNKGVDESLPIEERLKRHIIDGERIGLEAQLTKALEQYPPLEIINTFLLDGMKVVGELFGSGQMQLPFVLQSAETMKAAVAYLEPFMEKSESGNNAKGKVIIATVKGDVHDIGKNLVDIILSNNGYKVINLGIKQPVENIIEAYNQHKADCIAMSGLLVKSTAFMKENLEVFNEKGINVPVILGGAALTPKFVHKDCQNTYKGKVIYGKDAFSDLHFMDKLMPAKATGKWDNSLGFLDEVETEETEPTNHKSPIPSPQSPVPSPQSPVPIDTRRSEAVAIDIPRPTPPFWGTQLLQPSDISLEEIFWHMDLQALIAGQWQFRKPKEQSKEEYQAFLNEKVYPVLETWKQRIIAENLLHPQVIYGYFPCQSEGNTLYVYETNSPNATEITQFEFPRQKSSKRLCIADFFAPKDSGIIDVFPMQAVTVGEIATEFAQKLFANNQYTDYLYFHGLAVQVAEALAEWTHARIRRELGFGAEEPDNIRDILAQRYQGSRYSFGYPACPNIQDQFKQLDLLETSRINLYMDESEQLYPEQSTTAIITYHPVAKYFTA

SEQ ID NO: 5 - DNA, 3588 bp, Synechocystis sp.
  CDS (1)..(3585): RCY35965
atgaaaagtgcttttttagaccgtatccacagtcccgatcgcccggtattagtctttgacggggctatgggtacaaacctgcaggtacagaacctaacggcggcggattttggtggggcggaatacgaaggttgcaatgaatatttagtccataccaagccagaggccgtggctacggtgcatcgtgctttttacgaagcgggggccgatgtcgtggaaacggatacttttgggggaacgcccctggtgctggcggagtacgatttagcagaccaaagttattacttaaataaagcagcggcggagttggccaaggcggtagcagcggaattttctaccccagaaaagcctcgattcgtggccggctccatgggaccaggcaccaagctacccaccctaggtcatgtggactacgatagtctcaaggatgcctatgtggttcaggtgcggggtttatacgatggcggagtggatttattgctagtggaaacctgccaggatgtgctgcaaattaaagcggccttgaacgccattgaacaggtctttgccgaaaaaggcgatcgcctaccgttgatggtgtcagtaaccatggaaaccatggggaccatgctggtgggtacggagatggcggcggccctggccattttggagccctatcccatcgatattttggggctaaactgcgccaccgggccagatttgatgaaggaacacgttaaatatctttccgaacattccccctttgtggtgtcctgtattcccaatgctggtttgccagaaaacgttggcggtcaagctttttatcgcctcaccccgatggaactgcaaatgtccctgatgcacttcatcgaagacctgggagtacaggtaattggtggttgttgtggcactagacccgatcacatcaaggccctggcggatattgccaaggatctccagcccaaacaacgccaacctcactacgaacccagcgccgcttccatttattccacccaaacctacgcccaagaaaattcttttttaatcattggcgaacggctcaatgccagtggctcgaaaaaatgtcgagatctgctcaatgctgaagattgggacagcctagtttccctggctaaatcccaagtcaaggaaggagcccaaatccttgacgtcaacgtggattacgttggtcgagatggggtaagggacatgaaagaattagcttcccgactagtcaataatgtcaccctgccgttgatgttggactccaccgaatggcaaaaaatggaggcgggtttaaaagttgcagggggaaaatgtattctcaattccaccaactacgaagacggggaagaacggttttataaagtgttagaaattgccaaagaatatggagctggtattgtcattggcaccatcgatgaagatggcatgggacgcactgcagataaaaaatttgagattgccaaacgggcctacgaagcggcgatcgcctttggcattccggccacagaaattttctttgatcctttagctctgcctatttccaccggcattgaagaagacagggagaacggtaaagccaccgtggatgctatccgcagaattcgccaggaattgcccgattgtcatattttgttgggggtttctaacgtttcctttggcttgaatcccgccgctcgccaggtactcaattccatctttctccacgaatgtatgcaggtgggcatggatgcggccattgtcagtgccaataagattttacccctggcaaaaattgacccagaacaacaacaagtctgtctagatttaatctatgaccgccgggaatttgaaggagagcgctgtacatatgacccgttaaccaaactcaccactttatttgaaggtaaaaccaccaaacgggataaatccggtgatgccaatttaccggtggaagaaagattaaaacgccacatcattgatggggaaagattgggcttagaagaggccctcaatgaagctttaaaactttacgctcccttagatatcattaacatctatttgttggatggcatgaaagtggtgggggaactatttggttccgggcaaatgcagttgccctttgtgttgcagtcggcccaaaccatgaaagcggcggtggcttttttagaaccccatatggataaggatgattccgccgacaatgctaagggtacttttttaattgccactgttaagggggatgtccatgatattggcaaaaacttagtggatattatcctttccaacaatggctatcgagtggtcaacctaggcattaaacagccagtggaaaatattatcgaagcctacaaaaaacacaggcccgattgcattgccatgagtggtttgttggtcaaatcaactgcttttatgaaggaaaatttagaagttttcaaccaagagggcattactgttcccgtcattcttggtggtgctgctttaacgcctaaatttgttcaccaggactgccaaaatacctacaaaggccaagtaatttacggcaaagatgcgttcgccgatttacatttcatggataagctaatgcccgctaaaaatagccacaattgggatgatttccagggctttttaggggaatatgcaacggaaaatggccataatgtgaccactgatgatggtgctaaaactaattttggcattgaagaagaaaaattaattgacgctagtgagcagtctagggagccggaggtaattgatactgttcgttctgaagcggtggaccctgatctagaaagacctgtgccacctttttggggcactaaaattttgcaatccagtgatatttccctcgatgaagtcttccctttactggatttacaagcattatttgttggtcagtggcagtttcgcaaacctagggagcaatccagggaagaatacgagcaattcctagcggaaaaagttcatcccattttggctgagtggaaaggtaaggtcatggcagaaaatttactccatcctacggtggtttatggttattttccctgtcaatcccagggcaataccttgttaatttatgacccagaattggtcagccaaaataatggccaaattcccccagacgcaacggcgatcgccaaatttgagtttccccggcaaaaatcagggcggcggctctgtattgcggacttttttgcttcaaaagaatcggggattactgatgtttttcctttgcaagcggttacagtgggggaaatcgcgacggaatatgcaaggaaactttttgctggcgataattacaccgattacctctacttccacggcatggcggtgcagatggcggaagctttagcggagtggactcaccaacggatacgtcaggaattgggctttggccatttagatccagataacatccgtgatcttctccagcaacgttaccaaggttcccgctacagttttggttatcccgcttgtcccaacatgcaggatcaatacacacaattagaattgttacaaaccgaacgaattggcttgtatatggatgaaagtgaacaggtttatccagaacaatccaccacggcgattatttcctatcatcctgcggctaaatatttcagcgcttaa

SEQ ID NO: 6 - protein, 1195 aa, Synechocystis sp.
MKSAFLDRIHSPDRPVLVFDGAMGTNLQVQNLTAADFGGAEYEGCNEYLVHTKPEAVATVHRAFYEAGADVVETDTFGGTPLVLAEYDLADQSYYLNKAAAELAKAVAAEFSTPEKPRFVAGSMGPGTKLPTLGHVDYDSLKDAYVVQVRGLYDGGVDLLLVETCQDVLQIKAALNAIEQVFAEKGDRLPLMVSVTMETMGTMLVGTEMAAALAILEPYPIDILGLNCATGPDLMKEHVKYLSEHSPFVVSCIPNAGLPENVGGQAFYRLTPMELQMSLMHFIEDLGVQVIGGCCGTRPDHIKALADIAKDLQPKQRQPHYEPSAASIYSTQTYAQENSFLIIGERLNASGSKKCRDLLNAEDWDSLVSLAKSQVKEGAQILDVNVDYVGRDGVRDMKELASRLVNNVTLPLMLDSTEWQKMEAGLKVAGGKCILNSTNYEDGEERFYKVLEIAKEYGAGIVIGTIDEDGMGRTADKKFEIAKRAYEAAIAFGIPATEIFFDPLALPISTGIEEDRENGKATVDAIRRIRQELPDCHILLGVSNVSFGLNPAARQVLNSIFLHECMQVGMDAAIVSANKILPLAKIDPEQQQVCLDLIYDRREFEGERCTYDPLTKLTTLFEGKTTKRDKSGDANLPVEERLKRHIIDGERLGLEEALNEALKLYAPLDIINIYLLDGMKVVGELFGSGQMQLPFVLQSAQTMKAAVAFLEPHMDKDDSADNAKGTFLIATVKGDVHDIGKNLVDIILSNNGYRVVNLGIKQPVENIIEAYKKHRPDCIAMSGLLVKSTAFMKENLEVFNQEGITVPVILGGAALTPKFVHQDCQNTYKGQVIYGKDAFADLHFMDKLMPAKNSHNWDDFQGFLGEYATENGHNVTTDDGAKTNFGIEEEKLIDASEQSREPEVIDTVRSEAVDPDLERPVPPFWGTKILQSSDISLDEVFPLLDLQALFVGQWQFRKPREQSREEYEQFLAEKVHPILAEWKGKVMAENLLHPTVVYGYFPCQSQGNTLLIYDPELVSQNNGQIPPDATAIAKFEFPRQKSGRRLCIADFFASKESGITDVFPLQAVTVGEIATEYARKLFAGDNYTDYLYFHGMAVQMAEALAEWTHQRIRQELGFGHLDPDNIRDLLQQRYQGSRYSFGYPACPNMQDQYTQLELLQTERIGLYMDESEQVYPEQSTTAIISYHPAAKYFSA

SEQ ID NO: 7 - DNA, 3561 bp, Prochlorococcus marinus
  CDS (1)..(3558): RCK00830
atggtttcatttagaaattatttaaatagagatgataaaccaattattattttcgatggtgggacaggtacttcttttcaaaatttaaatttatcatcacatgattttggtggagatgatttagagggttgcaatgaaaacttagttctatcctctcctaatactgttgaacaagtacataattcatttcttgaagcaggttgtcatgtaattgaaaccaatacatttggtgcttcatctattgttttagacgaatatagtatttctaataaagcttatgaaatcaataaaaaagcagctcagatagctaaaaaatgtgcaaatttattttcatctattaatactcctagatttgtcgctggatcaattgggccaactacaaaattaccaacattaggtcatattagttttgataagcttaaagattcatatgaagaacaaataaatggtctaattgacggaggtattgaccttctattgattgaaacatgccaagatgttttacaaataaaatcagcattatctgcttctcaagaagttattaaaaacaggaatattgaattaccaataatgatatccataactatggaaaccacaggaacgatgcttgtcgggtcagatatagcttctgcattaacaatattagagccatacaatattgatattctgggactgaattgtgcaactggtccagttcaaatgaaagaacatattaagtatttagctgaaaattcaccttttgcaattagttgtatacctaatgcaggattacctgaaaatataggaggtgttgctcactataaattaactccattggagttgaaaatgcagttaatgaactttatttatgattttaacgtacaacttattggcggatgttgtggtactactcctgaacatatcaagcatttatcatcaatcattgaggaaatagttgataaaaaaataaataaaagacttcctactgtaaaaacaaattttgttccttcagcagcttctatatataacgcagttccatataaacaagataactcaatattaatagttggagaacgtttaaatgctagtggatcaaaaaaagtaagggaattactaaatgaagatgattgggacggcctgctatcaattgctaaacaacagcaaaaagaaaatgctcacatactagatgtcaatgttgattatgtaggaagagatggagttaaagatatgaaagaaattacctcaagattagttacaaatataaatcttccattaatgatagattcaacagaagcagataaaatggaaagtggattaaagactgtaggaggaaaatgcattataaattcaacaaactacgaagatggagatgacagatttaatcaggtcttaagacttgcattagattatggtgctggaatagtaattggaactattgatgaagatggaatggcaagaacatcacagaaaaaatatgacattgcaaaaagagcattaattaaaactagatcaagtggcctcgctgattatgagatattttttgatcctctagcattgccaatatctactggaattgaagaagatagattaaatgctaaagcaactattgaagctatatcaaaaataagaaaaagctttccagatattcatattattttagggatatctaatattagtttcgggctttcaccattatcaagaattaatctaaattcaatatttctcgatgaatgtataaaggcaggattagattcagcgattattgcaccaaataaaatattgcctctttcaaaaatatctgcggaaacaaaaaaattatgtttagatttaatttatgacagaagaaatttcgaaaatgaaatatgtatatatgatccattagttgaactaacaaaagcattccaagatataacaatcagtgactttaaaaaaggatctacttcaaacaaaaacctcaccttagaagaaaaacttaaaaaccatattgtagatggggaaaaaataggtttagaagaacaattaaataatgcgcttaaaaagtacaaaccacttgaaataattaatacttatttattagatggaatgaaagtagtcggtgaactatttggatccggccaaatgcaattaccttttgtattgcaatcagcggaaacaatgaaatttgctgtttcagtgcttgaacctcatatggaaacagtagatgaaaaaatatctaacggaaaattactaatagcaactgttaaaggagatgttcatgatataggtaaaaatttagttgatataattctctcaaataatggttttgatgtaatcaaccttggaattaagcaagatgtttcagcgattattgatgcacaaaaaaaacataaagcagactgtattgctatgagtggtttacttgttaaatctacagcatttatgaaggataatttagaagcatttaacaatgctgaaattaatgttccagttattcttggaggtgcagcattaactccaaaatttgtgaatgaagattgtagtcagatatataaaggtaaaattttgtatgggaaagatgcttttacagatttacaatttatgaatgactatatggatagtaaaaagaagggcaattggtctaatgaaaatggttttactaatactgatgatattcaaattaaattagcttccccaaggtcttccgctaaagataaaaatttaaataaaaattttgaaaaaaccaaaagtattcaattaattgagaattttaatagatctaattttgtagaggaagaggaacctataaaggctccatttttgggaactagagttcttcaagatattgaaatagactttgacaaactaattttttatctagataaaaaagcattatttagtggtcaatggcaaattaaaaaaaataaaggtcaatcagtagaagaatacaataattatttagattcatatgcaaatccattacttgaaaaatggattaatattattttagataaaggcttaatttcaccaaaagtagtctatggctacttccgttgcgggaggaatgataatagtatttatctctttgataatgtatcaaataaaagaatttctgaatttaactttcctagacaaaaatcgggaaataatctttgtattgcagatttttactgtgatcttaaaaataatgatccagtagatatatttccaatgcaagcagtaacaatgggggaaatagctagcgaatattcccaagaattatttaaagctgataaatatagtgattatttaatatttcatggtttaaccgttcaattagcagaagctcttgcagaatatgttcattcaatagtaagaattgaatgcggatttaaatcatatgagccaaacaataaccgtgatatattagctcaaaaatatagaggagctagatactcatttggttatccagcttgtcctaaagtttctgattcaaatatacagttatcattattggatacaaaaaggattaatttaacaatggatgaatcagagcaattacatcctgaacaaagtactactgctataatttcacttcattcaaaagcaaaatattttagtgcctaa

SEQ ID NO: 8 - protein, 1186 aa, Prochlorococcus marinus
MVSFRNYLNRDDKPIIIFDGGTGTSFQNLNLSSHDFGGDDLEGCNENLVLSSPNTVEQVHNSFLEAGCHVIETNTFGASSIVLDEYSISNKAYEINKKAAQIAKKCANLFSSINTPRFVAGSIGPTTKLPTLGHISFDKLKDSYEEQINGLIDGGIDLLLIETCQDVLQIKSALSASQEVIKNRNIELPIMISITMETTGTMLVGSDIASALTILEPYNIDILGLNCATGPVQMKEHIKYLAENSPFAISCIPNAGLPENIGGVAHYKLTPLELKMQLMNFIYDFNVQLIGGCCGTTPEHIKHLSSIIEEIVDKKINKRLPTVKTNFVPSAASIYNAVPYKQDNSILIVGERLNASGSKKVRELLNEDDWDGLLSIAKQQQKENAHILDVNVDYVGRDGVKDMKEITSRLVTNINLPLMIDSTEADKMESGLKTVGGKCIINSTNYEDGDDRFNQVLRLALDYGAGIVIGTIDEDGMARTSQKKYDIAKRALIKTRSSGLADYEIFFDPLALPISTGIEEDRLNAKATIEAISKIRKSFPDIHIILGISNISFGLSPLSRINLNSIFLDECIKAGLDSAIIAPNKILPLSKISAETKKLCLDLIYDRRNFENEICIYDPLVELTKAFQDITISDFKKGSTSNKNLTLEEKLKNHIVDGEKIGLEEQLNNALKKYKPLEIINTYLLDGMKVVGELFGSGQMQLPFVLQSAETMKFAVSVLEPHMETVDEKISNGKLLIATVKGDVHDIGKNLVDIILSNNGFDVINLGIKQDVSAIIDAQKKHKADCIAMSGLLVKSTAFMKDNLEAFNNAEINVPVILGGAALTPKFVNEDCSQIYKGKILYGKDAFTDLQFMNDYMDSKKKGNWSNENGFTNTDDIQIKLASPRSSAKDKNLNKNFEKTKSIQLIENFNRSNFVEEEEPIKAPFLGTRVLQDIEIDFDKLIFYLDKKALFSGQWQIKKNKGQSVEEYNNYLDSYANPLLEKWINIILDKGLISPKVVYGYFRCGRNDNSIYLFDNVSNKRISEFNFPRQKSGNNLCIADFYCDLKNNDPVDIFPMQAVTMGEIASEYSQELFKADKYSDYLIFHGLTVQLAEALAEYVHSIVRIECGFKSYEPNNNRDILAQKYRGARYSFGYPACPKVSDSNIQLSLLDTKRINLTMDESEQLHPEQSTTAIISLHSKAKYFSA

SEQ ID NO: 9 - DNA, 3048 bp, Thermus thermophilus
  CDS (1)..(3045): RTT00266
atgcgggcctacaaggaggcggcacgggggcttcttaagggcggggtggacctcatcctcttggagaccgcccaggacatcctccaggtgcgctgcgccgtcttggcggtgcgggaggccatggccgaggtgggccgggaggtgcccctccaggtccaggtgacctttgaggccacggggacgatgctcgtgggcacggacgagcaggcggccctggccgctctggagagcctccccgtggacgtggtggggatgaactgcgccacgggccccgacctcatggacagcaaggtgcgctacttcgccgagcacagcacccgcttcgtctcctgcctcccgaacgcgggcctgccccggaacgagggggggagggtggtctacgacctcacccccgaggagctcgccaagtggcacctcaagttcgtggccgagtacggggtgaacgccgtggggggatgctgcggcacggggcccgagcacataaggaaggtggccgaggcggtgaaggggctcgccccgaagccaaggcccgaaagcttccctccccaggtggcctccttgtaccaggcggtgtccctcaagcaggaggcgagccttttcctcgtgggggagaggctcaacgccacggggagcaagcgcttccgggagatgctcttcgcgagagacctcgagggcatcctcgccctcgcccgggagcaggtggaggagggggcccacgccctggacctctccgtggcctggacggggcgggacgagcttgaggacctccggtggctccttccccatctcgccaccgcccttaccgtccccgtcatggtggactccacctcccctgaggccatggagctcgccctcaaatacctcccgggccgggtcctcctgaactccgccaacctcgaggatggcttagagcgctttgaccgggtggcctccctggccaaggcccacggggcggccctcgtggtcctcgccattgacgagaaggggatggccaagacccgggaggagaaggtgcgggtggccctgaggatgtacgagcgcctcacggagcaccacggcctccgccccgaggacctcctctttgacctccttaccttccccatcacccaaggggacgaggagagccgccctctggccaaggagaccctcctcgccatagaggagctacgggagaggcttcccggggtgggcttcgtccttcgggtctccaacgtctccttcgggctcaagccccgggcgaggcgcgtcctgaactccgtcttcctggacgaggcgaggaaacggggcctcaccgcggccatcgtggacgcggggaagatcctccccataagccagatccccgaggaggcctacgccctcgccttagacctcatctacgaccgccgcaaggagggctttgaccccctcctcgccttcatggcctactttgaggcccacaaggaggacccggggaagagggaggacgccttcctggcccttccccttctggagaggctcaagcgccgcgtggtggaggggaggaagcagggcctcgaggccgacctggaggaggccctgaaggcggggcacaagcccttggacctcatcaacggccccctcctcgcggggatgaaggaggtgggggacctcttcggggcggggaagatgcagctccccttcgtcctccaggccgccgaggtgatgaagcgggcggtggcctacctcgagccccacatggagaagaagggggagggcaagggtaccctggtcctcgccaccgtcaagggggacgtgcacgacatcggcaagaacctggtggacatcatcctcagcaacaacggctaccgggtggtgaacctggggatcaaggtgcccattgaggagatcctgaaggccgtggaggcgcacaagccccacgccgtgggcatgtcgggcctcctggtgaagagcaccctggtgatgaaggagaacctggagtacatgcgggataggggctacaccctccccgtgatcctgggcggggccgccctcacccggagctacgtggaggagcttaaggccatctaccccaacgtctactacgccgaggacgcctttgagggcttaaggctcatggaggagctcacgggccacgcccctcccgagctcacccggaaggccccagctaggcccaagcgggaggcccccaaggtggcgccccgcgctcggcccgtgggggaggcccccgccgtcccccggccccccttcttcggcgtgcgggtggaggaaggcttggacctcgccaccatcgcccactacgtcaacaagctcgccctctaccggggccagtggggctacagccgcaagggctttcccgggaggcgtggcaggccctggtggagcgggaggcggagcctgtcttccagaggctcctcaaggaggcgatggcggaagggtggcttgaacccaaggtcctctacggcttcttccccgtggcccgggaggggaggagcttctcgtcttctccccagagacgggggaggtgctggagcgcttccgcttcccccggcaaaggggcgggggcctgagcctcgtggactacttccgcccccggtttgccgcgcctttgggggacgaggcggactggatgcccaaggaggccttccgggcgggggccgggacgtcctcggggtccagctcgtcaccatgggggaggccccttcccgaaaggcccaggccctctttgcgtccggggcctaccaggactacctcttcgtccacggcttcagcgtggagatgaccgaggccttggcggagtactggcacaagaggatgcggcagatgtggggcatcgcccacaaggacgccaccgagatccagaagctcttccagcagggctaccagggggcccgctactccttcggctaccccgcctgcccggacctcgccgaccaggccaagctggaccggctcatgggcttccaccgggtgggggtgcacctcacggagaacttccagctggagccggagcacgccaccagcgccctcgtggtccaccaccccgaggcccgctacttcagcgtggactag

SEQ ID NO: 10 - protein, 1015 aa, Thermus thermophilus
MRAYKEAARGLLKGGVDLILLETAQDILQVRCAVLAVREAMAEVGREVPLQVQVTFEATGTMLVGTDEQAALAALESLPVDVVGMNCATGPDLMDSKVRYFAEHSTRFVSCLPNAGLPRNEGGRVVYDLTPEELAKWHLKFVAEYGVNAVGGCCGTGPEHIRKVAEAVKGLAPKPRPESFPPQVASLYQAVSLKQEASLFLVGERLNATGSKRFREMLFARDLEGILALAREQVEEGAHALDLSVAWTGRDELEDLRWLLPHLATALTVPVMVDSTSPEAMELALKYLPGRVLLNSANLEDGLERFDRVASLAKAHGAALVVLAIDEKGMAKTREEKVRVALRMYERLTEHHGLRPEDLLFDLLTFPITQGDEESRPLAKETLLAIEELRERLPGVGFVLRVSNVSFGLKPRARRVLNSVFLDEARKRGLTAAIVDAGKILPISQIPEEAYALALDLIYDRRKEGFDPLLAFMAYFEAHKEDPGKREDAFLALPLLERLKRRVVEGRKQGLEADLEEALKAGHKPLDLINGPLLAGMKEVGDLFGAGKMQLPFVLQAAEVMKRAVAYLEPHMEKKGEGKGTLVLATVKGDVHDIGKNLVDIILSNNGYRVVNLGIKVPIEEILKAVEAHKPHAVGMSGLLVKSTLVMKENLEYMRDRGYTLPVILGGAALTRSYVEELKAIYPNVYYAEDAFEGLRLMEELTGHAPPELTRKAPARPKREAPKVAPRARPVGEAPAVPRPPFFGVRVEEGLDLATIAHYVNKLALYRGQWGYSRKGFPGRRGRPWWSGRRSLSSRGSSRRRWRKGGLNPRSSTASSPWPGRGGASRLLPRDGGGAGALPLPPAKGRGPEPRGLLPPPVCRAFGGRGGLDAQGGLPGGGRDVLGVQLVTMGEAPSRKAQALFASGAYQDYLFVHGFSVEMTEALAEYWHKRMRQMWGIAHKDATEIQKLFQQGYQGARYSFGYPACPDLADQAKLDRLMGFHRVGVHLTENFQLEPEHATSALVVHHPEARYFSVD

SEQ ID NO: 11 - DNA, 3441 bp, Bacillus halodurans
  CDS (1)..(3438): RHD05550
atgactaaatcgttgtttgaacaacagttagagcgaaaaatcgtcatccttgatggggcgatggggaccatgttacaagccgcgaatctaaccgctgatgactttggcggagaagagtatgaagggtgtaatgaatatttaaatgagacggccccccatgtcgttgaggacattcatcgcgcatacttagaggcaggagcagacgtcattgcgacgaacacgttcggggcaacagatatcgttcttgacgattatgatctcggatacaaagcagaggagttaaacatatgcgcggtgaaaatcgctaaacgtgtagctgaagagttttccactccagattggcctcgattcgttgcaggggcgatggggccgacgacgaaatctctttccgtcacagggggcgcgacattcgaacaacttatcgagtcttatcgccagcaagctacaggtctaattaaaggcggggcggatattttattactcgaaacgagccaggatatgcgaaacgtgaaggcggcttatttaggactgagccaagcgcaaaaagagctagaggtgaaactgcctctcattatttctggaacgattgaaccgatgggaacaacgctcgccggccaaaacatcgaggcgttctatttgtcattagagcatatgaatcccgtcgttgtcggtctcaactgcgctacaggaccagaatttatgcgcgatcacctccgttctctttcagaccttgcgacctgctctgtaagctgttatccgaatgctgggttacctgatgaagaggggaactatcacgaatccccagaatcattagcagccaagctcgcaggttttgcggaaaagggctggttgaatatggttggtggctgttgcgggacgactccagaccacattcgtgctcttttggacgttatgaagcaatttgagccgagacaaccaaaaggggatcacccccactcggtctcaggaattgagccactgttatacgatgacagcatgcgtccactatttgtcggtgaacggacaaacgtcatcgggtctcgtaaatttaaacggttgatcgaagaagaaaaatatgaagaagcctcagaaattgcaagatcccaagtgaagaaaggggcccacgttatcgatgtttgtcttgctgatccggatcgcgatgaaatggaggacatggaggaatttttaaaattcgtgatcaacaaagtgaaggtaccgctcatgattgactccaccgacgaaaaggtaattgaacaagcgcttacgtattcacaagggaaagcgatcattaattcgatcaacttagaggacggcgaagaacgttttgaaaaagtggtcccgctcgtccataagtatggagccgcggttgtcgttggtacgatcgacgaagaaggaatggcgattacggcagaaaaaaaattagcggttgcgaaacgatcatacgacctgctcgtaaacaaatacaacattcgtccgagcgatattatttttgatccgctcgtgttcccagtaggaacaggcgatgagcaatacattggctcggcgaatgagacggtggaaggaattaggaggatcaaagaagagctccctgaatgtttaacgattcttggagttagtaacgtgtcgttcggtcttccgcctgtcggaagagaggtgctgaacgcggcgtacttataccattgtacacaagctggccttgattacgctatcgtgaacacagaaaagcttgagcgttatgcctcgatttctgatgaagaaaaagaattgtcaaggaagctcttatttgaaacgacagatgaaacgctcgctgagttcaccgccttttatcgagggaaaaaagcagagaaaaaagtggagacttctaatttaactttggaagagcggttggcaaactacattgttgaagggtcaaaggacggactgacagaagatttagataaagcgctcgcgaaatatgatgatccgcttgatatcattaacggcccgctcatgaatggaatggacgaagtcggtcgtttgtttaacaataacgagcttattgtcgctgaagtattgcaaagcgctgaggttatgaaggcttccgtcgcccaccttgagccacatatggaaaagaaagcagacgatcatggaaaaggaaaaatcattcttgccacggtcaagggcgatgttcacgatatcgggaaaaatctagtggaaattattttgagcaataatggtttccgcatcgtgaacctaggaattaaagttacctctaatgagctgattgaagcggtggcgagagaaaatccagatgcgattggcttgtcagggttgctcgtcaaatcagcacaacaaatggtacttaccgcccaagatttgaagcaacaacaaatttccattccgattttagtcggaggcgcagcccttacgcggaaatttacgaatacaaaaatcgctccagagtatgatggtctcgtcgtctacgcgaaggatgcgatgaacgggttagagcttgccaataaattaatgaaacctgatgaacgagaaaagctagcggtctccctccatgaagcgaaggagcaggcgaactcgaggacacaaatgggaggaggcggaactgcagttgcggtaaagccgactcgatcccatgtttcgacaacggtgcctgtagcggtcccacctgatgtgaagccgcacattttgcgccaccatagcattgcccatttagagccgtatattaacatgcagatgttgttaggacgtcacttaggcttacaagggaaagtgagccgcctgcttgcagaaaaagacgagaaggctcttgaattaaaagaaaaagttgatgcgctactcaccagggtgaaagaggagcagctcatggaagcccatggcatgtatcagttttttcctgcccagtcggatggggacgatattgtcatttatgatcaaacgggaacaaatgaaatcgagcgattccattttccgcgtcagaataaggagccttatctgtgtcttgccgatttccttcgcccagtttccagtggggaaatggactatgttggcttccttgctgtaaccgcaggaaaaggcattcgtgaattaggggagcaggcgaaagaggctggagactatttattcagtcacttaatccaagcaacagccttagagatggcggaagggtttgccgagcgtgtccatcagctcatgcgtgataagtgggggtttcctgattcggctgactttacaatggaagagcgtttcgctgcaaaataccgtggcatccgtgtatcgtttggctaccctgcatgccctgacttggatgaccaagcaaagttgtttaagctgttgaagcctggaaagatcggaattgagttgacggaagggtttatgatggagccagaagcctccgtcaccgcgatggtgtttgcccatcctgaggctcgctattttaatgttttatag

SEQ ID NO: 12 - protein, 1146 aa, Bacillus halodurans
MTKSLFEQQLERKIVILDGAMGTMLQAANLTADDFGGEEYEGCNEYLNETAPHVVEDIHRAYLEAGADVIATNTFGATDIVLDDYDLGYKAEELNICAVKIAKRVAEEFSTPDWPRFVAGAMGPTTKSLSVTGGATFEQLIESYRQQATGLIKGGADILLLETSQDMRNVKAAYLGLSQAQKELEVKLPLIISGTIEPMGTTLAGQNIEAFYLSLEHMNPVVVGLNCATGPEFMRDHLRSLSDLATCSVSCYPNAGLPDEEGNYHESPESLAAKLAGFAEKGWLNMVGGCCGTTPDHIRALLDVMKQFEPRQPKGDHPHSVSGIEPLLYDDSMRPLFVGERTNVIGSRKFKRLIEEEKYEEASEIARSQVKKGAHVIDVCLADPDRDEMEDMEEFLKFVINKVKVPLMIDSTDEKVIEQALTYSQGKAIINSINLEDGEERFEKVVPLVHKYGAAVVVGTIDEEGMAITAEKKLAVAKRSYDLLVNKYNIRPSDIIFDPLVFPVGTGDEQYIGSANETVEGIRRIKEELPECLTILGVSNVSFGLPPVGREVLNAAYLYHCTQAGLDYAIVNTEKLERYASISDEEKELSRKLLFETTDETLAEFTAFYRGKKAEKKVETSNLTLEERLANYIVEGSKDGLTEDLDKALAKYDDPLDIINGPLMNGMDEVGRLFNNNELIVAEVLQSAEVMKASVAHLEPHMEKKADDHGKGKIILATVKGDVHDIGKNLVEIILSNNGFRIVNLGIKVTSNELIEAVARENPDAIGLSGLLVKSAQQMVLTAQDLKQQQISIPILVGGAALTRKFTNTKIAPEYDGLVVYAKDAMNGLELANKLMKPDEREKLAVSLHEAKEQANSRTQMGGGGTAVAVKPTRSHVSTTVPVAVPPDVKPHILRHHSIAHLEPYINMQMLLGRHLGLQGKVSRLLAEKDEKALELKEKVDALLTRVKEEQLMEAHGMYQFFPAQSDGDDIVIYDQTGTNEIERFHFPRQNKEPYLCLADFLRPVSSGEMDYVGFLAVTAGKGIRELGEQAKEAGDYLFSHLIQATALEMAEGFAERVHQLMRDKWGFPDSADFTMEERFAAKYRGIRVSFGYPACPDLDDQAKLFKLLKPGKIGIELTEGFMMEPEASVTAMVFAHPEARYFNVL

SEQ ID NO: 13 - DNA, 3411 bp, Bacillus stearothermophilus
  CDS (1)..(3408): RBE02044
atggctaacgtcaccttagaacagcaactgcaaagaaaaattcttgtcatcgatggcgccatgggcacgatgatccaaagcgccaacctatcggccgccgactttggcggcgaggcgtatgaagggtgcaacgaatatttgaccctcaccgccccgcatgtcatccgccgcattcatgaagcgtacctagaagccggtgctgatatcattgaaacgaacacgttcggagcgacacgcatcgtgcttgacgaatatggcctcggtcatttggcgcttgagctgaacatcgaagcggccaaactcgccaaacaaacggctgagtcgttctccaccccggactggccgcgctttgtcgccggttcgatggggccgacgacgaaaacgttgtcggtgacaggcggcgcaacgtttgaagaactcgtcgccgcctacgaagaacaagcgcgcggactgctcttaggaggcgtcgaccttctcctactcgagacgtgccaagatacgctgaatgtcaaagccggttttctcggcatttcgaaggcgtttgaagcggtcggccgccgcgtgccgctcatgatttccggcacgatcgaaccgatgggcacgacgctcgccgggcaggcgatcgatgcgtttttcatctcggtgcgccatatgaagccgatcgccgtcggcttaaactgcgcaaccggtccggagtttatgaccgaccatttgcgcacgctcgcctcgctcgctgacacggcggtcagctgctacccgaacgccggtctgccggatgaggaaggccactatcatgaaacgccgaatatgctggcagagaaaatccgccgctttgccgaaaagggatggatcaacatcgtcggcgggtgttgcggcacgacgccggatcatatccgcgccattgctgaagcggtgcgtgatctcccgccgcgggcgattccgtcttcgtttgatgtccacgccgtttccggcatcgaggcgctcatctatgatgaaacgatgcgcccgctctttgtcggcgagcggacaaacgtgatcggctcgcgcaaattcaagcgcctcatcgccgaagggaaatacgaagaagcggcggaaatcgcccgcgcccaagtgaaaaacggcgcccatgtcatcgacatttgcctcgccgacccagaccgcgacgaactccatgacatggagcagttcgtccgcgaagtcgtgaaaaaagtgaaagtgccgcttgtcatcgattcgaccgacgagcgcgtcatcgaacgcgcccttacgtattcgcaagggaaggcgatcatcaactcgatcaacctcgaagatggcgaagagcggtttgcgaaggtcgttcctctcctgcatcaatacggcgccgccgttgtcgtcggcacgatcgatgagcaaggaatggcggttacagccgaacggaaattggaaatcgccttgcgttcgtatgacttgctggtgaaccgctacggcgtccccgagcgcgacatcattttcgacccgctcgtcttcccggtcggcaccggcgatgagcaatacatcggcgcggcgaaagaaaccattgagggcatccgcctcattaaagagcggctgcctcattgcttgacgatgcttggcatcagcaacgtctcgttcggcttgccgccggccggacgcgaggtgctcaactccgtctttttgtaccattgcacgcaagccgggctcgattacgccatcgtcaacaccgagaaattggagcggttcgcctcgattccggaagaggaagtgcgaatggctgaggcacttctttttgacacaaacgacgaaacattaaacgcctttatcgaattttaccgaagcaaaatcaccgccgccaaaccggcgcagacgaacttgagcttggaagagcggctcgcccgctacgttattgaagggtcgaaagacgggctcattctcgatttggaaaaggcgcttgagacctactccgatccgctgtccatcatcaacggtccgctcatggccggcatggatgaagtcgggcggctgttcaacaacaaccagctcatcgtcgctgaagtattgcaaagcgcggaagtgatgaaagcagcggtcgcctttttagagctgtatatggaaaagaaagaaggaagcacaaaaggaaaagtcattctcgccaccgtcaaaggcgatgtgcatgacatcggcaaaaacttggtcgacatcattttaagcaacaacggctacgaggtgatcgacctcggcattaaagtcgctccgcagcaactcattgaagcggtgcgcgaacatcagccggacatcatcgggttgtcgggcttgcttgtgaaatcggctcaacagatggtcgtcaccgcccaagacttgcgccaagcgggcatctcgaccccgattttagtcggcggcgccgccttgacgcgcaaatttacggaaaacaaaatcgcgcccgagtacgacggcgttgtcttgtacgcgaaagacgccatggacgggctcgcccttgccaaccaaatccagcagggcgagattgactacaagaaaaaagaaacggccgaaagcgagccaacgcggcaaacgacggtggtcacagcggtcaaatcgaccgtctcgaccgacgttcccgtctacatcccggccgatctcgagcgccacgcgctgcgaaatgtgccgcttgaccacattttgccgtacgtcaactggcaaatggtgctcggccaccacctcggcttgaaaggaaaagtgaaacggctgcttgaagagaaagacgaaaaagcgttggcgttaaaagcggtcgtcgacgaactgctcgccgaagcgaaagagcgccgctggattcagcccgccggcgtctaccgcttcttcccggcgcaaagcgacggcaaccgggtttacatttacgatccgactgacggcaaaacagtgctcgagatgttcgactttccgcgccaaccgcgggcgccgtatctttgcctcgccgattatttgaaatcgaaagaaagcggcgaaatggattacgtcggtttgttcgccgtcaccgctgggcatggcgtccgcgaactcgcccagcgctggaaggaagaaggcgaatttttgaaaagccatgccatccaagcgttggcgctcgagattgccgaagggttcgccgaacgaatccatcaaattatgcgcgaccgctggggcttcccggacgacccggatttcacgatggaagagcgcttcgccgccaaataccagggccagcgctactcgttcggctacccggcctgtccgaacttggaagaccaggagaaactgttccgtctgcttcatccagaagacatcggcatccgtctcaccgacggctatatgatggaacccgaagcatcggtttcggcgatcgtcttcgcccatccggaagcgcggtatttcaatgtgttataa

SEQ ID NO: 14 - protein, 1136 aa, Bacillus stearothermophilus
MANVTLEQQLQRKILVIDGAMGTMIQSANLSAADFGGEAYEGCNEYLTLTAPHVIRRIHEAYLEAGADIIETNTFGATRIVLDEYGLGHLALELNIEAAKLAKQTAESFSTPDWPRFVAGSMGPTTKTLSVTGGATFEELVAAYEEQARGLLLGGVDLLLLETCQDTLNVKAGFLGISKAFEAVGRRVPLMISGTIEPMGTTLAGQAIDAFFISVRHMKPIAVGLNCATGPEFMTDHLRTLASLADTAVSCYPNAGLPDEEGHYHETPNMLAEKIRRFAEKGWINIVGGCCGTTPDHIRAIAEAVRDLPPRAIPSSFDVHAVSGIEALIYDETMRPLFVGERTNVIGSRKFKRLIAEGKYEEAAEIARAQVKNGAHVIDICLADPDRDELHDMEQFVREVVKKVKVPLVIDSTDERVIERALTYSQGKAIINSINLEDGEERFAKVVPLLHQYGAAVVVGTIDEQGMAVTAERKLEIALRSYDLLVNRYGVPERDIIFDPLVFPVGTGDEQYIGAAKETIEGIRLIKERLPHCLTMLGISNVSFGLPPAGREVLNSVFLYHCTQAGLDYAIVNTEKLERFASIPEEEVRMAEALLFDTNDETLNAFIEFYRSKITAAKPAQTNLSLEERLARYVIEGSKDGLILDLEKALETYSDPLSIINGPLMAGMDEVGRLFNNNQLIVAEVLQSAEVMKAAVAFLELYMEKKEGSTKGKVILATVKGDVHDIGKNLVDIILSNNGYEVIDLGIKVAPQQLIEAVREHQPDIIGLSGLLVKSAQQMVVTAQDLRQAGISTPILVGGAALTRKFTENKIAPEYDGVVLYAKDAMDGLALANQIQQGEIDYKKKETAESEPTRQTTVVTAVKSTVSTDVPVYIPADLERHALRNVPLDHILPYVNWQMVLGHHLGLKGKVKRLLEEKDEKALALKAVVDELLAEAKERRWIQPAGVYRFFPAQSDGNRVYIYDPTDGKTVLEMFDFPRQPRAPYLCLADYLKSKESGEMDYVGLFAVTAGHGVRELAQRWKEEGEFLKSHAIQALALEIAEGFAERIHQIMRDRWGFPDDPDFTMEERFAAKYQGQRYSFGYPACPNLEDQEKLFRLLHPEDIGIRLTDGYMMEPEASVSAIVFAHPEARYFNVL

SEQ ID NO: 15 - DNA, 3681 bp, Vibrio cholerae
  CDS (1)..(3678): RVC04265
gtgggaaaagaagtaagacaacaactcgaacagcaattgaaacaacgtatcctactgattgatggtggtatgggtaccatgattcagagttataagttacaagaggaagactatcgcggtgcacgatttgtcgattggcactgtgatttgaaaggaaataacgacctcttagtgcttactcagccgcaaattattaaagagattcactccgcttaccttgaagcgggggcggatattcttgagaccaacacctttaactcaaccacgattgccatggcagactatgacatgcaatcgctcagtgctgaaattaactttgccgcggctaagcttgcacgtgaagtcgcggatgagtggacggctaaagatccaagtcggccacgctatgtggctggtgtgcttgggccaaccaaccgtacttgctctatttcgccagatgtgaacgatccaggatttcgtaacgtcacttttgatgggcttgttgaagcctattccgaatcgacgcgcgctttgatcaaaggtggcagcgatctgatcctcattgaaaccatcttcgatacacttaacgccaaagcctgtgcgtttgcggtcgatagcgtatttgaagagctgggcatcagcttacctgtgatgatttccggcacgattaccgatgcctctgggcgaactctgtcaggacagacaacggaagctttctacaacgccttgcgtcatgtacggccgatttcgtttggcttgaactgtgcgttaggtcctgatgagctgcgccagtacgtggaagagctttcacgcatttcagaatgctatgtttccgcgcacccaaatgccggactgcccaatgcgtttggtgaatacgatctctctgccgaggaaatggcagaacatattgcggaatgggcacaagctggctttttgaatttggtcggtggttgctgtggaactacacctgagcatatcgccgccattgccaaagccgtcgagggtgtaaaaccaagggctctgccagatctgaaagtagaatgtcgtctctcgggtttagagccgctcaatattggtcctgaaaccttgtttgttaacgtgggcgaacgtactaacgtcaccggttctgcgcgttttaagcgtttaattaaagaagagcaatacgacgaagcgctcgatgtggcgcgtgagcaagtcgaaaacggcgcgcagatcattgatatcaacatggatgaaggcatgttggacgccgaggcgtgtatggtgcgctttttgaatctatgcgcctctgaaccagaaatatccaaagttccggtgatggtcgactcctctaaatgggaagtcattgaagcgggtctgaaatgcattcagggtaaaggcatcgtcaactctatctctctaaaagaagggaaagagaagtttattgcccaagccaaattggtgcgccgctacggtgccgcggtgattgtgatggcatttgacgaagtgggccaagccgatacccgtgagcgcaaattagagatctgtcgtcgggcttaccatattttggtcgatgaggtgggcttcccaccggaagatattatttttgacccgaacatctttgctgttgcgaccggaattgatgagcacaataactacgcactggatttcattaatgcagtggcggacattaagcgtgagctgccgcatgcgatgatttctggcggtgtttctaacgtttccttctctttccgcggcaacaactatgtgcgtgaagcgatccatgctgttttcctttatcactgcttcaaacacggcatggacatggggattgtcaacgcagggcagcttgaaatctacgataacgttccgctgaaactgcgtgaggcagtggaagatgtgatcctcaatcgacgtagcgatggcacggaaagactgcttgagatcgccgaagcgtatcgcgaaaacagtgttggtaaagaagaggatgcttctgcattagagtggcgcgcatggcctgtggctaagcgcctagagcacgctttagtcaaaggcatcaccgaatttatcgtccaagacactgaagaagcacgtcagcaagccagtaaaccactggaagtgattgaagggccgctgatggatggtatgaacgtggtcggtgacttgttcggggaagggaaaatgttcctaccgcaagtcgtaaaatcagcgcgtgtcatgaaacaagccgttgcgtatcttgagcctttcattaatgcgcaaaaaagtggtagcacttcaaatggtaagattttgctggcgaccgtaaaaggcgatgtgcatgacattggtaagaacattgttggcgtcgtgctgcagtgtaataacttcgagatcatcgatcttggtgtgatggtgccttgcgagcagatcctcaaagtcgcacgcgagcaaaatgtcgatatcatcggtctctctgggcttatcacgccgtctttggatgagatggtacacgtggcgaaagagatggagcgacaagggtttgaactgccacttttgattggtggggcaacaacgtctaaagcgcatactgcggtgaagattgaacagaattatcatgcgcctgtagtgtacgtgaataacgcgtcgcgcgcggtaggggtgtgcacatcattattgtctgatgaacagcgccccggatttatcgaacgtttggatctcgattatgagcgcacgcgtgatcagcatgctcgtaaaacgcccaaatcgcgcccagtcacgttagagcaggcacgtgctaataaagcggcgctggattgggcaaattacacgccgcccgctcctgcgaaaccgggtgtgcatgtgtttgaaaacattgcgttagccacactacgtccttatatcgattggacgcctttttttatgacttggtcgcttatgggcaaataccctgccattttggagcatgaagaggtcggtgaagaggccaaacgtctgtttcatgatgccaatgccttacttgataaagtagagcgagaaggactactgaaagccagtggtatgtgtgcactgtttccagcagccagcgtgggcgatgacattgaggtgtacagtgatgaatcgcgtacgcaagtcgcgcatgtgctgtacaacttgcgtcagcagactgagaaaccgaaaggggccaactactgtttgtcggactatgttgctccgaaagagagcggtaaacgtgattggattggcgcgtttgcagtaactggtggcattggtgagcgagccttggccgatgcttataaagctcagggtgatgattacaatgcgatcatgatccaagcggtagccgatcgtttggcggaagcctttgcggaatatctgcatgaaaaagtgcgtaaagagatttggggttatgcgagcgatgaaaatctctccaatgatgacctgatccgtgagcgttatcagggcattcgacccgcgccggggtatcccgcgtgtcctgagcataccgagaaagcgactttgtggcagatgctaaatgtcgaagagaccataggtatgtcactgaccacaagctatgcgatgtggccgggcgcttcggtatccggttggtatttctcgcatcccgattctcgctattttgcggtagcgcagatccaaccagatcaactgcacagctacgctgagcgtaaaggttggcgtttggaagaagctgaaaagtggctagcgcctaaccttgatgcttaa

SEQ ID NO: 16 - protein, 1226 aa, Vibrio cholerae
VGKEVRQQLEQQLKQRILLIDGGMGTMIQSYKLQEEDYRGARFVDWHCDLKGNNDLLVLTQPQIIKEIHSAYLEAGADILETNTFNSTTIAMADYDMQSLSAEINFAAAKLAREVADEWTAKDPSRPRYVAGVLGPTNRTCSISPDVNDPGFRNVTFDGLVEAYSESTRALIKGGSDLILIETIFDTLNAKACAFAVDSVFEELGISLPVMISGTITDASGRTLSGQTTEAFYNALRHVRPISFGLNCALGPDELRQYVEELSRISECYVSAHPNAGLPNAFGEYDLSAEEMAEHIAEWAQAGFLNLVGGCCGTTPEHIAAIAKAVEGVKPRALPDLKVECRLSGLEPLNIGPETLFVNVGERTNVTGSARFKRLIKEEQYDEALDVAREQVENGAQIIDINMDEGMLDAEACMVRFLNLCASEPEISKVPVMVDSSKWEVIEAGLKCIQGKGIVNSISLKEGKEKFIAQAKLVRRYGAAVIVMAFDEVGQADTRERKLEICRRAYHILVDEVGFPPEDIIFDPNIFAVATGIDEHNNYALDFINAVADIKRELPHAMISGGVSNVSFSFRGNNYVREAIHAVFLYHCFKHGMDMGIVNAGQLEIYDNVPLKLREAVEDVILNRRSDGTERLLEIAEAYRENSVGKEEDASALEWRAWPVAKRLEHALVKGITEFIVQDTEEARQQASKPLEVIEGPLMDGMNVVGDLFGEGKMFLPQVVKSARVMKQAVAYLEPFINAQKSGSTSNGKILLATVKGDVHDIGKNIVGVVLQCNNFEIIDLGVMVPCEQILKVAREQNVDIIGLSGLITPSLDEMVHVAKEMERQGFELPLLIGGATTSKAHTAVKIEQNYHAPVVYVNNASRAVGVCTSLLSDEQRPGFIERLDLDYERTRDQHARKTPKSRPVTLEQARANKAALDWANYTPPAPAKPGVHVFENIALATLRPYIDWTPFFMTWSLMGKYPAILEHEEVGEEAKRLFHDANALLDKVEREGLLKASGMCALFPAASVGDDIEVYSDESRTQVAHVLYNLRQQTEKPKGANYCLSDYVAPKESGKRDWIGAFAVTGGIGERALADAYKAQGDDYNAIMIQAVADRLAEAFAEYLHEKVRKEIWGYASDENLSNDDLIRERYQGIRPAPGYPACPEHTEKATLWQMLNVEETIGMSLTTSYAMWPGASVSGWYFSHPDSRYFAVAQIQPDQLHSYAERKGWRLEEAEKWLAPNLDA

SEQ ID NO: 17 - DNA, 3822 bp, Sinorhizobium meliloti
  CDS (1)..(3819): RSM07338
gtgagtaaatcgataattctttgtcgttttcagaacgggagatctcccatgtccgccgccgacgccctctttggaaacgtctcgcccaagccggatggttcggaagtctttcggcagctcgcccaggcggcggctgaacgcatcctcatcatggatggcgccatgggaacggagatccagcagctcggtttcgtggaggatcacttccgcggcgagcgcttcggtggctgcgcctgccatcagcagggcaacaacgacctcctgacgctcactcagccgaaggcgatcgaggatattcattaccactacgccatcgccggcgccgatatcctcgaaaccaacaccttctcctcgacgcggatcgcccaggccgattacggcatggaggacatggtctacgatctcaatcgcgacggcgcgcggctggcgcggcgagccgcgaagcgggccgaggcggaggatggccggcggcgcttcgtggcaggcgcgctcggccccaccaaccgcaccgcttcgatttcgccggacgtcaacaaccccggctatcgagccgtcagcttcgacgatctgaggctcgcctatgccgagcaggtgcggggcctcatcgacggcggtgccgacatcatcctgatcgagacgatcttcgacacgctgaatgccaaggcggcgatcttcgcgacgcaggaagtctttgccgaaaagggcgtccgccttccggtgatgatctccggaacgatcaccgatctctccggccgtaccctctccggccagacgcctacggccttctggtattcggtgcgccatgcggatccgtttacgatcgggctcaactgcgcgctcggcgcaaatgcgatgcgcgcccatatagacgagctttcggcggtcgccgacacgctcgtctgcgcctatccgaatgccggcctgccgaacgagttcggccgctatgacgaaagccccgagcagatggcggcgcaggtcgagggcttcgcccgggacggtctcgtcaacatcgtcggcggctgctgcggttccacgccggcccatatccgcgccattgccgaagcggttgccaaatatccgccgcgccgggtgcccgagatcgatcgccgcatgcggctttccggcctcgaacccttcacgcttaccgacgagattcccttcgtcaacgtcggcgaacgcaccaacgtcaccggctcggcgaagttccgcaagctgatcaccgccggggactacgccgccgcactcgatgtggcgcgtgatcaggtggcgaatggcgcccagatcatcgacgtcaacatggacgaaggcctgatcgattcgaagcaggtgatggtcgagttcctgaacctcgtcgcctccgagccggatatcgcccgtgtaccggtgatgatcgattcgtcgaaatgggaggtgatcgaagccgggctcaaatgcgtccagggcaaggcgctggtgaactccatctcgctcaaggaaggcgaggcggctttcctgcaccatgcgcgcctcgtgcgcgcctatggcgccgcggtcgtggtgatggcgttcgacgagaagggccaggccgacacgaaaacccgcaaggtggaaatctgccggcgggcctatcggctgctgacggaagaggttggcttccccccggaggacatcatcttcgacccgaatatcttcgcggtcgcgaccggcatcgaggagcacaacaattacggcgtcgacttcatcgaggcgacgcacgagatcatcgcggcactgccgcatgtccacgtctccggcggcgtgtcgaacctctccttttccttccgcggcaacgagccggtgcgcgaggcgatgcacgccatcttcctttatcacgcgatccaggccggcatggacatgggcatcgtcaatgccggacagctcgccgtctatgatgcgatcgacccggaactgcgcgaaacctgcgaggacgtggtgctcaaccgccgggccgattcgaccgagcgcctcctggagatcgccgagcgctatcgcgggaagggcgggagccagggcaaggagaaggaccttgcctggcgcgaatggccggtggagaagcggctcgaacacgcgctcgtcaatggaattaccgaatttatcgaagccgatacggaagaggcccggcttgccgccgagcggccgctgcatgtcatcgaaggcccgctgatggccgggatgaacgtcgtgggcgatctcttcggttccggcaagatgttcctgccgcaggtggtcaagtccgcccgggtgatgaagcaggccgttgcggtgctgctcccccatatggaggaggagaagcgcgccaatggcggcggcgaggcgcgcgagagtgccggcaagatcctgatggcgaccgtcaagggcgacgtgcacgacatcggcaagaacatcgtcggcgtcgtgctcgcctgcaacaattacgagatcatcgacctcggcgtcatggtgccctcggctaagatcctcgaagtggcgcgcgaacagaaggtcgacatcgtcggtctttccggcctcatcacgccgtcgctggacgagatggcgcatgtcgcttccgagctcgaacgggagggcttcgatgtcccgctgctgatcggcggggcgacgaccagccgcgtgcacacggccgtgaagatcaatccgcgttacagcctcggccagacggtctatgtcaccgacgccagccgcgcggtcggcgtcgtatcgagcctgctctcgccggaagtccgcgactcctacaagaaaacggtccgcgcggagtatctgaaggttgccgacgcacatgcccgcaacgaagccgagaagcgccgtctgccgctttcccaggcgcgggcgaatgcctttcggatagattgggacgcccaccagccgaaggttccgtccttcctcggcacgcgtgttttcgagggatgggacctcgccgaactcgcccgctatatcgactggacgccgttcttccagacctgggagctgaagggggtattcccgaaaatcctcgatgacgaacgccagggggctgccgctcgccagctcttcgaggatgcgcaggcgatggtcgaaaagatcgtggccgaggcatggttcgccccgaaggccgtgatcggcttctggccggccgccagcatgggcgacgacgtccgcctgtttgccgacgaggtgcgcgaagccgagcttgccaccttcttcacgctccgccagcagatggtgaagcgcgacggccggccgaacgtcgcccttgccgacttcgtcgccccggcggcgagcggcaagcgggactatgtcggcggtttcgtggtgacggccggcatcgaggaagtggcgatcgccgaacgcttcgaacgggcgaacgacgattattcctcgatcatggtcaaggcgcttgcggaccgcttcgcagaggcctttgccgagcgcatgcatgaatatgtccgcaaggagctctggggctatgctccggacgaagccttcacgccgcaggaattgatcgccgagccctatgccggcatccgccctgcgcccggctacccggcgcagcccgaccacacggaaaaggagacgcttttccggctcctggatgcggaagccgctatcggcgtccggctcaccgagagctatgcgatgtggccgggctcttcggtatcgggcctctatgtcggccaccccgattcctattacttcggcgtcgcaaagatcgagcgcgatcaggtggaggactatgccgatcgcaagcgcatgagcgtccgcgaggtcgagcgctggctttcgccgatcctcaattacgtgccgatgccggagacggaagcggcggagtag

SEQ ID NO: 18 - protein, 1273 aa, Sinorhizobium meliloti
VSKSIILCRFQNGRSPMSAADALFGNVSPKPDGSEVFRQLAQAAAERILIMDGAMGTEIQQLGFVEDHFRGERFGGCACHQQGNNDLLTLTQPKAIEDIHYHYAIAGADILETNTFSSTRIAQADYGMEDMVYDLNRDGARLARRAAKRAEAEDGRRRFVAGALGPTNRTASISPDVNNPGYRAVSFDDLRLAYAEQVRGLIDGGADIILIETIFDTLNAKAAIFATQEVFAEKGVRLPVMISGTITDLSGRTLSGQTPTAFWYSVRHADPFTIGLNCALGANAMRAHIDELSAVADTLVCAYPNAGLPNEFGRYDESPEQMAAQVEGFARDGLVNIVGGCCGSTPAHIRAIAEAVAKYPPRRVPEIDRRMRLSGLEPFTLTDEIPFVNVGERTNVTGSAKFRKLITAGDYAAALDVARDQVANGAQIIDVNMDEGLIDSKQVMVEFLNLVASEPDIARVPVMIDSSKWEVIEAGLKCVQGKALVNSISLKEGEAAFLHHARLVRAYGAAVVVMAFDEKGQADTKTRKVEICRRAYRLLTEEVGFPPEDIIFDPNIFAVATGIEEHNNYGVDFIEATHEIIAALPHVHVSGGVSNLSFSFRGNEPVREAMHAIFLYHAIQAGMDMGIVNAGQLAVYDAIDPELRETCEDVVLNRRADSTERLLEIAERYRGKGGSQGKEKDLAWREWPVEKRLEHALVNGITEFIEADTEEARLAAERPLHVIEGPLMAGMNVVGDLFGSGKMFLPQVVKSARVMKQAVAVLLPHMEEEKRANGGGEARESAGKILMATVKGDVHDIGKNIVGVVLACNNYEIIDLGVMVPSAKILEVAREQKVDIVGLSGLITPSLDEMAHVASELEREGFDVPLLIGGATTSRVHTAVKINPRYSLGQTVYVTDASRAVGVVSSLLSPEVRDSYKKTVRAEYLKVADAHARNEAEKRRLPLSQARANAFRIDWDAHQPKVPSFLGTRVFEGWDLAELARYIDWTPFFQTWELKGVFPKILDDERQGAAARQLFEDAQAMVEKIVAEAWFAPKAVIGFWPAASMGDDVRLFADEVREAELATFFTLRQQMVKRDGRPNVALADFVAPAASGKRDYVGGFVVTAGIEEVAIAERFERANDDYSSIMVKALADRFAEAFAERMHEYVRKELWGYAPDEAFTPQELIAEPYAGIRPAPGYPAQPDHTEKETLFRLLDAEAAIGVRLTESYAMWPGSSVSGLYVGHPDSYYFGVAKIERDQVEDYADRKRMSVREVERWLSPILNYVPMPETEAAE

SEQ ID NO: 19 - DNA, 3684 bp, Escherichia coli
  CDS (1)..(3681): REC03905
gtgagcagcaaagtggaacaactgcgtgcgcagttaaatgaacgtattctggtgctggacggcggtatgggcaccatgatccagagttatcgactgaacgaagccgattttcgtggtgaacgctttgccgactggccatgcgacctcaaaggcaacaacgacctgctggtactcagtaaaccggaagtgatcgccgctatccacaacgcctactttgaagcgggcgcggatatcatcgaaaccaacaccttcaactccacgaccattgcgatggcggattaccagatggaatccctgtcggcggaaatcaactttgcggcggcgaaactggcgcgagcttgtgctgacgagtggaccgcgcgcacgccagagaaaccgcgctacgttgccggtgttctcggcccgaccaaccgcacggcgtctatttctccggacgtcaacgatccggcatttcgtaatatcacttttgacgggctggtggcggcttatcgagagtccaccaaagcgctggtggaaggtggcgcggatctgatcctgattgaaaccgttttcgacacccttaacgccaaagcggcggtatttgcggtgaaaacggagtttgaagcgctgggcgttgagctgccgattatgatctccggcaccatcaccgacgcctccgggcgcacgctctccgggcagaccaccgaagcattttacaactcattgcgccacgccgaagctctgacctttggcctgaactgtgcgctggggcccgatgaactgcgccagtacgtgcaggagctgtcacggattgcggaatgctacgtcaccgcgcacccgaacgccgggctacccaacgcctttggtgagtacgatctcgacgccgacacgatggcaaaacagatacgtgaatgggcgcaagcgggttttctcaatatcgtcggcggctgctgtggcaccacgccacaacatattgcagcgatgagtcgtgcagtagaaggattagcgccgcgcaaactgccggaaattcccgtagcctgccgtttgtccggcctggagccgctgaacattggcgaagatagcctgtttgtgaacgtgggtgaacgcaccaacgtcaccggttccgctaagttcaagcgcctgatcaaagaagagaaatacagcgaggcgctggatgtcgcgcgtcaacaggtggaaaacggcgcgcagattatcgatatcaacatggatgaagggatgctcgatgccgaagcggcgatggtgcgttttctcaatctgattgccggtgaaccggatatcgctcgcgtgccgattatgatcgactcctcaaaatgggacgtcattgaaaaaggtctgaagtgtatccagggcaaaggcattgttaactctatctcgatgaaagagggcgtcgatgcctttatccatcacgcgaaattgttgcgtcgctacggtgcggcagtggtggtaatggcctttgacgaacagggacaggccgatactcgcgcacggaaaatcgagatttgccgtcgggcgtacaaaatcctcaccgaagaggttggcttcccgccagaagatatcatcttcgacccaaacatcttcgcggtcgcaactggcattgaagagcacaacaactacgcgcaggactttatcggcgcgtgtgaagacatcaaacgcgaactgccgcacgcgctgatttccggcggcgtatctaacgtttctttctcgttccgtggcaacgatccggtgcgcgaagccattcacgcagtgttcctctactacgctattcgcaatggcatggatatggggatcgtcaacgccgggcaactggcgatttacgacgacctacccgctgaactgcgcgacgcggtggaagatgtgattcttaatcgtcgcgacgatggcaccgagcgtttactggagcttgccgagaaatatcgcggcagcaaaaccgacgacaccgccaacgcccagcaggcggagtggcgctcgtgggaagtgaataaacgtctggaatactcgctggtcaaaggcattaccgagtttatcgagcaggataccgaagaagcccgccagcaggctacgcgcccgattgaagtgattgaaggcccgttgatggacggcatgaatgtggtcggcgacctgtttggcgaagggaaaatgttcctgccacaggtggtcaaatcggcgcgcgtcatgaaacaggcggtggcctacctcgaaccgtttattgaagccagcaaagagcagggcaaaaccaacggcaagatggtgatcgccaccgtgaagggcgacgtccacgacatcggtaaaaatatcgttggtgtggtgctgcaatgtaacaactacgaaattgtcgatctcggcgttatggtgcctgcggaaaaaattctccgtaccgctaaagaagtgaatgctgatctgattggcctttcggggcttatcacgccgtcgctggacgagatggttaacgtggcgaaagagatggagcgtcagggcttcactattccgttactgattggcggcgcgacgacctcaaaagcgcacacggcggtgaaaatcgagcagaactacagcggcccgacggtgtatgtgcagaatgcctcgcgtaccgttggtgtggtggcggcgctgctttccgatacccagcgtgatgattttgtcgctcgtacccgcaaggagtacgaaaccgtacgtattcagcacgggcgcaagaaaccgcgcacaccaccggtcacgctggaagcggcgcgcgataacgatttcgcttttgactggcaggcttacacgccgccggtggcgcaccgtctcggcgtgcaggaagtcgaagccagcatcgaaacgctgcgtaattacatcgactggacaccgttctttatgacctggtcgctggccgggaagtatccgcgcattctggaagatgaagtggtgggcgttgaggcgcagcggctgtttaaagacgccaacgacatgctggataaattaagcgccgagaaaacgctgaatccgcgtggcgtggtgggcctgttcccggcaaaccgtgtgggcgatgacattgaaatctaccgtgacgaaacgcgtacccatgtgatcaacgtcagccaccatctgcgtcaacagaccgaaaaaacaggcttcgctaactactgtctcgctgacttcgttgcgccgaagctttctggtaaagcagattacatcggcgcatttgccgtgactggcgggctggaagaggacgcactggctgatgcctttgaagcgcagcacgatgattacaacaaaatcatggtgaaagcgcttgccgaccgtttagccgaagcctttgcggagtatctccatgagcgtgtgcgtaaagtctactggggctatgcgccgaacgagaacctcagcaacgaagagctgatccgcgaaaactaccagggcatccgtccggcaccgggctatccggcctgcccggaacatacggaaaaagccaccatctgggagctgctggaagtggaaaaacacactggcatgaaactcacagaatctttcgccatgtggcccggtgcatcggtttcgggttggtacttcagccacccggacagcaagtactacgctgtagcacaaattcagcgcgatcaggttgaagattatgcccgccgtaaaggtatgagcgttaccgaagttgagcgctggctggcaccgaatctggggtatgacgcggactga

SEQ ID NO: 20 - protein, 1227 aa, Escherichia coli
VSSKVEQLRAQLNERILVLDGGMGTMIQSYRLNEADFRGERFADWPCDLKGNNDLLVLSKPEVIAAIHNAYFEAGADIIETNTFNSTTIAMADYQMESLSAEINFAAAKLARACADEWTARTPEKPRYVAGVLGPTNRTASISPDVNDPAFRNITFDGLVAAYRESTKALVEGGADLILIETVFDTLNAKAAVFAVKTEFEALGVELPIMISGTITDASGRTLSGQTTEAFYNSLRHAEALTFGLNCALGPDELRQYVQELSRIAECYVTAHPNAGLPNAFGEYDLDADTMAKQIREWAQAGFLNIVGGCCGTTPQHIAAMSRAVEGLAPRKLPEIPVACRLSGLEPLNIGEDSLFVNVGERTNVTGSAKFKRLIKEEKYSEALDVARQQVENGAQIIDINMDEGMLDAEAAMVRFLNLIAGEPDIARVPIMIDSSKWDVIEKGLKCIQGKGIVNSISMKEGVDAFIHHAKLLRRYGAAVVVMAFDEQGQADTRARKIEICRRAYKILTEEVGFPPEDIIFDPNIFAVATGIEEHNNYAQDFIGACEDIKRELPHALISGGVSNVSFSFRGNDPVREAIHAVFLYYAIRNGMDMGIVNAGQLAIYDDLPAELRDAVEDVILNRRDDGTERLLELAEKYRGSKTDDTANAQQAEWRSWEVNKRLEYSLVKGITEFIEQDTEEARQQATRPIEVIEGPLMDGMNVVGDLFGEGKMFLPQVVKSARVMKQAVAYLEPFIEASKEQGKTNGKMVIATVKGDVHDIGKNIVGVVLQCNNYEIVDLGVMVPAEKILRTAKEVNADLIGLSGLITPSLDEMVNVAKEMERQGFTIPLLIGGATTSKAHTAVKIEQNYSGPTVYVQNASRTVGVVAALLSDTQRDDFVARTRKEYETVRIQHGRKKPRTPPVTLEAARDNDFAFDWQAYTPPVAHRLGVQEVEASIETLRNYIDWTPFFMTWSLAGKYPRILEDEVVGVEAQRLFKDANDMLDKLSAEKTLNPRGVVGLFPANRVGDDIEIYRDETRTHVINVSHHLRQQTEKTGFANYCLADFVAPKLSGKADYIGAFAVTGGLEEDALADAFEAQHDDYNKIMVKALADRLAEAFAEYLHERVRKVYWGYAPNENLSNEELIRENYQGIRPAPGYPACPEHTEKATIWELLEVEKHTGMKLTESFAMWPGASVSGWYFSHPDSKYYAVAQIQRDQVEDYARRKGMSVTEVERWLAPNLGYDAD

SEQ ID NO: 21 - DNA, 3771 bp, Salmonella typhimurium
  CDS (1)..(3768): RSY02996
atgtctcatgttgcccgttgttctcttttccgccagcacgctttgtgccagtatggctcgttacgtggagcgttgtcgggagcgagtgtgagcagcaaagttgaacaactgcgtgcgcagttaaatgaacgtattctggtgctggacggcggtatgggcactatgatccagagctatcgtctacatgaagaagatttccgcggggagcgctttgccgactggccctgcgacctgaaaggcaacaatgacctgctggtcctcagcaagccggaggtgatcgccgctatccacaacgcctactttgaggctggcgcggatatcatcgaaaccaacacctttaactcgacaaccattgcgatggcggattaccggatggaatccctgtcggcggaaattaactatgcggcggccaaactggcgcgcgcctgcgccgatgaatggacggcgcgaacaccagaaaaaccacgctttgttgcgggcgtgcttggtccaactaaccgcacggcctccatttcgccggacgtcaacgacccggcgtttcgtaatatcaccttcgatcagctggtggcggcctaccgtgaatccaccaaagcgctggtggaaggtggcgcagatctgattctgattgagaccgtttttgacaccctgaatgcgaaagcggcggtgtttgcggtgaaagaagagtttgaagcgctgggcgttgacctgccgatcatgatttccggcaccatcaccgacgcctctggccgtacgctttccggccagactaccgaagccttttataactcgctgcgccacgccgaggcgctcacttttggccttaactgcgcactggggccagatgaactgcgccagtacgtccaggaactgtcgcggattgccgaatgctacgtcaccgcgcacccgaacgccggcctgccgaacgctttcggcgagtatgacctcgacgccgacaccatggcgaaacagattcgcgaatgggcggaagcgggcttcctgaatatcgttggcggctgctgcggcaccacgccggagcatattgcggcgatgagccgcgccgttgccggtttgctgccgcgccagctgccggatatcccggtcgcctgccgcctttccggcctggagccgctgaacattggcgacgatagcctgtttgtgaacgtcggcgaacgtactaacgtcaccggctcggccaaatttaaacggctgatcaaagaagagaaatacagcgaagcgctggatgtcgcccgtcagcaggtagaaagcggcgcgcagattattgatatcaatatggatgaggggatgctcgacgccgaagcggcgatggtgcgtttcctcagcctgattgccggtgagccggacattgcccgtgtaccaatcatgatcgactcctccaaatgggaggttatcgaaaaagggctgaagtgcattcagggtaaaggcatcgtcaactctatttcgatgaaagagggcgtggaagcctttattcatcatgcgaagcttctgcgtcgctacggcgcggcagtggtggtgatggcctttgatgagcaggggcaggccgatacccgcgcgcgtaaaatcgaaatttgccgccgagcctacaaaattctcaccgaagaggtgggtttcccgccggaagacatcatcttcgacccgaatatcttcgccgtggcgaccggtattgaagagcacaacaactacgcgcaggactttatcggcgcttgcgaagacatcaaacgcgagctgccgcacgcgctgatctccggcggcgtgtctaacgtgtccttctcgttccgcggcaacgacccggtacgtgaggctatccacgcggtattcctctactacgccatccgcaacggtatggacatgggcatcgtcaacgccggacagctggctatctacgacgacctgcccgccgagctgcgcgatgcggttgaagatgtcattcttaaccgtcgcgatgacggcactgagcgtttgctggatttggcggagaaataccgcggcagcaaaaccgacgaagctgccaacgcccagcaggcggaatggcgtagctgggacgtgaaaaagcgtctcgaatactcgctggtgaaaggcattaccgaatttatcgaacaggataccgaagaagcccgtcagcaggccgcccgcccgattgaggtgattgaagggccgttgatggacggcatgaacgtggtcggcgacctgttcggcgaagggaaaatgttcctgccgcaggtggtgaaatccgctcgcgtgatgaaacaagcggtggcctacctggagccgtttattgaagccagcaaagaaaaaggctccagcaacggcaagatggtgatcgccaccgtgaagggcgatgtgcacgatattggtaaaaatatcgttggcgtggtgctgcaatgtaacaactacgaaatcgtcgatcttggcgtgatggtgccagcggagaaaatcctcagaacggcgcgtgaagtgaatgccgatctgatcggtctttccgggctgattaccccgtcgctggacgaaatggtcaacgtggcgaaagagatggagcgtcagggctttactatcccgctactgatcggcggcgcaaccacttcgaaagcgcatacggcggtgaaaatcgagcagaactacagcggtccgacggtctacgtgcagaatgcttcgcgtaccgtgggcgtggtggcggcgctactctccgacacccagcgtgatgactttgtcgcccgtacccgcaaagagtacgaaaccgtgcgtattcagcacgcccgcaaaaaaccgcgcacgccgccggtcacgctggaggcggcgcgcgataacgatctggcattcgattgggaacgctacaccccgccggtagcccaccgtctgggcgtgcaggaggtggaagccagcatcgaaactctgcgcaactatatcgactggacgccgttctttatgacctggtcgctggccggcaaatacccgcgcattctggaagatgaggtggtgggcgttgaggcgcagcgtctgtttaaagacgccaatgatatgctggataaactgagcgccgagaaactgttgaatccgcgtggcgtggtgggcctgttcccggcgaaccgtgtgggtgacgacatcgaaatctatcgcgacgaaacccgtactcatgttctgacggtcagccaccacctgcgccagcagaccgagaaagtcggttttgccaactactgtctggcggattttgtcgcgccgaaactgagcggcaaagcggattacatcggtgctttcgcggtgaccggcggtctggaggaggatgcgctggcggacgccttcgaagcgcaacacgacgactataacaagatcatggtgaaagcgattgccgaccgtctggcggaagcgttcgcggaatatctgcatgagcgtgtacgtaaggtttactggggatatgcgccgaacgagagcctgagtaacgacgaattaatccgcgaaaactaccaggggattcgcccggcgccgggttatcctgcctgcccggaacataccgaaaaaggcactatctggcagctactggatgtcgaaaaacacaccgggatgaagctcaccgaatctttcgccatgtggccaggcgcgtcggtctccggctggtacttcagccatcctgagagcaaatacttcgcggtagcgcagatccaacgcgatcaggtgacagattatgctttccgtaaaggaatgagcgttgaggatgttgagcggtggctcgcgccgaacctgggttacgatgcggactga

SEQ ID NO: 22 - protein, 1256 aa, Salmonella typhimurium
MSHVARCSLFRQHALCQYGSLRGALSGASVSSKVEQLRAQLNERILVLDGGMGTMIQSYRLHEEDFRGERFADWPCDLKGNNDLLVLSKPEVIAAIHNAYFEAGADIIETNTFNSTTIAMADYRMESLSAEINYAAAKLARACADEWTARTPEKPRFVAGVLGPTNRTASISPDVNDPAFRNITFDQLVAAYRESTKALVEGGADLILIETVFDTLNAKAAVFAVKEEFEALGVDLPIMISGTITDASGRTLSGQTTEAFYNSLRHAEALTFGLNCALGPDELRQYVQELSRIAECYVTAHPNAGLPNAFGEYDLDADTMAKQIREWAEAGFLNIVGGCCGTTPEHIAAMSRAVAGLLPRQLPDIPVACRLSGLEPLNIGDDSLFVNVGERTNVTGSAKFKRLIKEEKYSEALDVARQQVESGAQIIDINMDEGMLDAEAAMVRFLSLIAGEPDIARVPIMIDSSKWEVIEKGLKCIQGKGIVNSISMKEGVEAFIHHAKLLRRYGAAVVVMAFDEQGQADTRARKIEICRRAYKILTEEVGFPPEDIIFDPNIFAVATGIEEHNNYAQDFIGACEDIKRELPHALISGGVSNVSFSFRGNDPVREAIHAVFLYYAIRNGMDMGIVNAGQLAIYDDLPAELRDAVEDVILNRRDDGTERLLDLAEKYRGSKTDEAANAQQAEWRSWDVKKRLEYSLVKGITEFIEQDTEEARQQAARPIEVIEGPLMDGMNVVGDLFGEGKMFLPQVVKSARVMKQAVAYLEPFIEASKEKGSSNGKMVIATVKGDVHDIGKNIVGVVLQCNNYEIVDLGVMVPAEKILRTAREVNADLIGLSGLITPSLDEMVNVAKEMERQGFTIPLLIGGATTSKAHTAVKIEQNYSGPTVYVQNASRTVGVVAALLSDTQRDDFVARTRKEYETVRIQHARKKPRTPPVTLEAARDNDLAFDWERYTPPVAHRLGVQEVEASIETLRNYIDWTPFFMTWSLAGKYPRILEDEVVGVEAQRLFKDANDMLDKLSAEKLLNPRGVVGLFPANRVGDDIEIYRDETRTHVLTVSHHLRQQTEKVGFANYCLADFVAPKLSGKADYIGAFAVTGGLEEDALADAFEAQHDDYNKIMVKAIADRLAEAFAEYLHERVRKVYWGYAPNESLSNDELIRENYQGIRPAPGYPACPEHTEKGTIWQLLDVEKHTGMKLTESFAMWPGASVSGWYFSHPESKYFAVAQIQRDQVTDYAFRKGMSVEDVERWLAPNLGYDAD

SEQ ID NO: 23 - DNA, 3771 bp, Salmonella typhi
  CDS (1)..(3768): RTY03686
atgtctcatgttgcccgttgttctcttttccgccagcacgctttgtgccagtatggctcgttacgtggagcgttgtcgggagcgagtgtgagcagcaaagttgaacaactgcgtgcgcagttaaatgaacgtattctggtgctggacggcggtatgggcaccatgatccagagctatcgtctacatgaagaagatttccgcggggagcgctttgccgactggccctgcgacctgaaaggcaacaatgacctgctggtcctcagcaagccggaggtgatcgccgctatccacaacgcctactttgaggctggcgcggatatcatcgaaaccaacacctttaactcgacaaccattgcgatggcggattaccggatggaatccctgtcggcggaaattaactatgcggcggccaaactggcgcgcgcctgcgccgatgaatggacggcgcgaacaccagaaaaaccacgctttgttgcgggcgtgcttggtccaactaaccgcacggcctccatttcgccggacgtcaacgacccggcgtttcgtaatatcaccttcgatcagctggtggcggcctaccgtgaatccaccaaagcgctggtggaaggcggggcggacctgatcctgattgaaactgtcttcgacaccctcaacgccaaagcggcggtgtttgcggtgaaagaagagtttgaagcgctgggcgttgatctgccgatcatgatttccggcaccatcaccgacgcctctggccgtacgctttccggccagacgaccgaagccttttataactcgctgcgccacgccgaggcgctcacttttggccttaactgcgcgctggggccagatgaactgcgccagtacgtccaggaactgtcgcggattgccgaatgctacgtcaccgcgcacccgaacgccggcctgccgaacgctttcggcgagtacgacctcgacgccgacaccatggcgaaacagattcgcgaatgggcggaagcgggcttcctgaatatcgttggcggctgctgcggcaccacgccggagcatattgcggcgatgagccgcgccgttgccggtttgtcgccgcgccagctgccggatatcccggtggcctgccgcctttccggcctggagccgctgaacattggtgacgatagcctgtttgtcaacgtcggcgaacgtactaacgtcaccggctcggccaaatttaaacgcttgatcaaagaagagaaatacagcgaagcgctggatgtcgcccgtcagcaggtcgaaagcggcgcgcagattattgatatcaatatggatgaggggatgctcgacgccgaagcggcgatggtgcgtttcctcagcctgattgccggtgagccggacattgcccgtgtaccaatcatgattgactcctccaaatgggaggttatcgaaaaagggctgaagtgcattcagggtaaaggcatcgtcaactctatttcgatgaaagagggcgtggaagcctttattcatcatgcgaagttgctacgtcgctacggcgccgcagtggtggtgatggcttttgatgagcaggggcaggccgacacccgcgaacgtaaaatcgagatttgccgccgcgcttacaaaattttgctcgaagaggtaggctttccgccggaagacatcatcttcgacccgaatatcttcgccgtcgccaccggtattgaagagcacaacaactacgcgcaggactttatcggcgcttgtgaagacatcaaacgcgagctgccgcacgcgctgatctccggcggcgtgtctaacgtgtccttctcgtttcgcggcaacgacccggtacgtgaggctatccacgcggtattcctctactacgccatccgcaacggcatggacatgggcatcgtcaacgccgggcaactggcgatttatgacaacctgcctgccgaactgcgcgatgcagttgaagatgtcattcttaaccgtcgcgatgacggcaccgagcgtttgctggatttggcggagaaatatcgcggcagcaaaaccgacgaggctgccagtgcccagcaggcggaatggcgtagctgggacgtgaaaaagcgtctcgaatactcgctggtgaaaggcattaccgagtttatcgaacaggataccgaagaagcccgtcagcaggccgcccgcccgattgaggtgattgaagggccgctgatggacggcatgaacgtggtcggcgacctgttcggcgaagggaaaatgttcctgccgcaggtggtgaaatccgctcgcgtgatgaaacaagcggtggcctacctggagccgtttattgaagccagcaaagaaaaaggctccagcaacggcaagatggtgattgccaccgtgaagggcgatgtgcacgacattggcaagaacattgtcggcgtggtgctgcaatgcaacaactacgaaatcgtcgatcttggcgtgatggtgccagcggagaaaatcctcagaacggcgcgtgaagtgaatgccgatctgattggtctttccgggcttatcaccccgtcgctggacgaaatggtcaacgtggcgaaagagatggagcgtcagggctttactatcccgctactgatcggcggcgcaaccacttcgaaagcgcatacggcggtgaaaatcgagcagaactacagcggtccgacggtctacgtgcagaatgcttcgcgtaccgtgggcgtggtggcggcgctactctccgacacccagcgtgatgactttgtcgcccgtacccgcaaagagtacgaaaccgtgcgtattcagcacgcccgcaaaaaaccgcgcacgccgccggtcacgctggaagcggcgcgcgataatgatctggcatttgattgggaacgctacaccccgccggtagcccaccgtctgggcgtgcaggaggtggaagccagcatcgaaacgctgcgcaactacatcgactggacgccgttctttatgacctggtcgctggccggcaaatacccgcgcattctggaagatgaggtggtgggcgttgaggcgcagcgtctgtttaaagacgccaatgatatgctggataaactgagcgccgagaaactgttgaatccgcgtggcgtggtgggcctgttcccggcgaaccgtgtgggtgacgacatcgaaatctatcgcgacgaaacccgtactcatgttctgacggtcagccaccacctgcgccagcagaccgagaaagttggttttgctaactactgtctggcggattttgtcgcgccgaaactgagcggcaaagcggactacatcggtgctttcgcggtgaccggcggtctgaaggaggatgcgctggcggacgccttcgaagcgcaacacgacgactataacaagatcatggtgaaagcgattgccgaccgtctggcggaagcgtttgccgagtatctgcatgagcgtgtacgtaaggtttactggggatatgcgccgaacgagagcctgagtaacgacgaattaatccgcgaaaactaccaggggattcgcccggcgccgggttatcctgcctgcccggaacataccgaaaaaggcactatctggcagctactggatgtcgaaaaacacaccgggatgaagctcaccgaatctttcgccatgtggcctggcgcgtcggtctccggctggtacttcagccatcctgagagcaaatacttcgcggtagcgcagatccaacgcgatcaggtgacagattatgctttccgtaaaggaatgagcgttgaggacgttgagcggtggctcgcgccgaacctgggttacgatgcggactga

SEQ ID NO: 24 - protein, 1256 aa, Salmonella typhi
MSHVARCSLFRQHALCQYGSLRGALSGASVSSKVEQLRAQLNERILVLDGGMGTMIQSYRLHEEDFRGERFADWPCDLKGNNDLLVLSKPEVIAAIHNAYFEAGADIIETNTFNSTTIAMADYRMESLSAEINYAAAKLARACADEWTARTPEKPRFVAGVLGPTNRTASISPDVNDPAFRNITFDQLVAAYRESTKALVEGGADLILIETVFDTLNAKAAVFAVKEEFEALGVDLPIMISGTITDASGRTLSGQTTEAFYNSLRHAEALTFGLNCALGPDELRQYVQELSRIAECYVTAHPNAGLPNAFGEYDLDADTMAKQIREWAEAGFLNIVGGCCGTTPEHIAAMSRAVAGLSPRQLPDIPVACRLSGLEPLNIGDDSLFVNVGERTNVTGSAKFKRLIKEEKYSEALDVARQQVESGAQIIDINMDEGMLDAEAAMVRFLSLIAGEPDIARVPIMIDSSKWEVIEKGLKCIQGKGIVNSISMKEGVEAFIHHAKLLRRYGAAVVVMAFDEQGQADTRERKIEICRRAYKILLEEVGFPPEDIIFDPNIFAVATGIEEHNNYAQDFIGACEDIKRELPHALISGGVSNVSFSFRGNDPVREAIHAVFLYYAIRNGMDMGIVNAGQLAIYDNLPAELRDAVEDVILNRRDDGTERLLDLAEKYRGSKTDEAASAQQAEWRSWDVKKRLEYSLVKGITEFIEQDTEEARQQAARPIEVIEGPLMDGMNVVGDLFGEGKMFLPQVVKSARVMKQAVAYLEPFIEASKEKGSSNGKMVIATVKGDVHDIGKNIVGVVLQCNNYEIVDLGVMVPAEKILRTAREVNADLIGLSGLITPSLDEMVNVAKEMERQGFTIPLLIGGATTSKAHTAVKIEQNYSGPTVYVQNASRTVGVVAALLSDTQRDDFVARTRKEYETVRIQHARKKPRTPPVTLEAARDNDLAFDWERYTPPVAHRLGVQEVEASIETLRNYIDWTPFFMTWSLAGKYPRILEDEVVGVEAQRLFKDANDMLDKLSAEKLLNPRGVVGLFPANRVGDDIEIYRDETRTHVLTVSHHLRQQTEKVGFANYCLADFVAPKLSGKADYIGAFAVTGGLKEDALADAFEAQHDDYNKIMVKAIADRLAEAFAEYLHERVRKVYWGYAPNESLSNDELIRENYQGIRPAPGYPACPEHTEKGTIWQLLDVEKHTGMKLTESFAMWPGASVSGWYFSHPESKYFAVAQIQRDQVTDYAFRKGMSVEDVERWLAPNLGYDAD

SEQ ID NO: 25 - DNA, 3711 bp, Pseudomonas fluorescens
  CDS (1)..(3708): RPU03563
atgtccgatcgcagcgtccgccttcaagctctcaagcaagctctcaaagagcgcatcctgattctcgacggcggcatgggcacgatgatccagagctacaagctcgaagagcaggattatcgcggcaaacgcttcgccgactggccgagcgacgtcaagggcaacaacgacctgttggtgctgacccgcccggacgtgatcggcggcatcgagaaagcctatctggatgccggtgccgacatcctcgagaccaacaccttcaacgccacgcagatttccatggccgactacggcatggaagaactggtctacgaactcaacgtagaaggcgcccgtctggcacgcaaggtcgccgacgcgaaaaccctcgagacccccgacaagccgcgcttcgtcgccggcgttctcggcccgaccagccgcacctgctcgctgtcgccggacgtcaacaacccgggctatcgcaacgtcaccttcgatgagctggtcgaaaactacaccgaggccaccaaaggcctgatcgagggcggcgcggatctgatcctgatcgaaaccatcttcgacaccctcaacgccaaagccgcgatcttcgccgtgcaaggcgtgttcgaagaactgggcttcgaattgccgatcatgatctccggcaccatcaccgacgcctccggccgtaccctgtcgggccagaccaccgaagcgttctggaactccgtggctcacgccaaaccgatttccgtcggtcttaactgcgccctcggcgcccgcgaactgcgtccgtacctggaagagctgtcggacaaggccagcacccacgtttcggcgcacccgaacgccggcctgccgaacgaattcggcgagtacgacgagctgccggtggacaccgccaaggtcatcgaagagttcgcccagagcggtttcctcaacatcgtcggcggttgctgcggcaccacgccgggccatatcgaagccatcgccaaagccgttgccggttacgcgccacggcagattccggacattcccaaggcctgccgcctgtcgggtctggaaccgttcaccattgatcgcagctcgctgttcgtcaacgtcggcgagcggaccaacatcaccgggtccgcgaaatttgcccggctgatccgtgaagacaactacaccgaagccctggaagtcgccctgcagcaggtcgaggccggcgcccaggtgatcgacatcaacatggacgaagggatgctcgattcgaagaaggccatggtgaccttcctcaatctgattgccggcgaaccggacatctcccgcgtaccgatcatgatcgactcctcgaaatgggacgtgatcgaagccggcctcaagtgcattcagggcaagggcatcgtcaactcgatcagcatgaaagaaggcgtcgagcagttcatccaccacgccaaactgtgcaagcgctatggcgccgccgtggtggtgatggcgttcgacgaagccggccaggctgacaccgaagcgcgcaagaaagagatctgcaaacgctcctacgacattctggtcaacgaagtcggcttcccgccggaagacatcattttcgacccgaacatcttcgccgtggccaccggcatcgaagaacacaacaactacgctgtggacttcatcaacgcctgtgcctacatccgcgacgagctgccgtatgccctgagctccggcggcgtgtccaacgtgtcgttctcgttccgcggcaacaacccggtgcgcgaggcgatccactcggtgttcctgctgtacgcgatccgcgccggcctgaccatgggtatcgtcaacgccggtcagctggagatctacgaccagatcccgcaggaactgcgcgacgccgttgaagacgtgatcctcaaccgcacgccggaaggcaccgacgccctcctcgccatcgccgacaagtacaagggcgacggcagcgtcaaggaagccgagaccgaagaatggcgcggctgggacgtcaacaaacgtctggaacatgcgctggtcaagggcatcaccacccacatcgtcgaagacaccgaagaatcccgtcagtccttcgcccgcccgatcgaagtgatcgaaggcccgctgatgtccggcatgaacatcgtcggcgacctgttcggcgccggcaaaatgttcctgccgcaagtggtgaaatccgcccgcgtgatgaagcaggccgtggcgcacctgattccgttcatcgaactggaaaaaggcgacaagccggaagccaagggcaagatcctgatggccacggtcaaaggcgacgtgcacgacatcggcaagaacatcgtcggcgtggtgctgggttgcaacggctacgacatcgtcgacctcggcgtgatggtgccggcggagaagatcctgcaggtggccaaggagcagaagtgcgacatcatcggcctgtccggtctgatcaccccgtcgctggatgagatggtccatgtggcccgcgagatgcagcgccaggacttccacctgccgctgatgatcggcggcgcgaccacctccaaggcgcacacggcggtgaagatcgagcccaagtacagcaacgacgcagtggtctacgtgaccgacgcctcccgcgccgtgggcgtggcgacgcagttgctgtccaaggaactgaaagccggtttcgtccagaagacccgcgaagagtacatcgacgtccgcgagcgcaccgccaaccgcagcgcccgcaccgaacgcctgagctacgccgccgcgatcgccaagaagccgcagttcgactgggccacttacaccccggtcaaaccgaccttcaccggcacccgcgtgctggacaacatcgacctcaacgttctcgccgagtacatcgactggacgccgttcttcatctcctgggacctggccggcaagttcccgcgcatcctcgaagacgaagtggtcggcgaagcggcgaccgcgctgtacaaggacgctcgcgagatgctgaccaagctgatcgacgagaaactgatcagcgcccgtgcggtgttcggcttctggccggccaatcaggtgcacgacgacgatatcgagctgtacggcgatgacggcaagccaatggcgcgcctgcatcacctgcgccagcagatcatcaagaccgacggcaaaccgaacttctccctcgccgacttcgtcgcgccgaaggacagcgaagtgaccgactacgttggtggtttcatcaccaccgccgggatcggcgccgaagaagtggccaaggcctatcaggacgccggcgacgattacaactcgatcatggtcaaggccctggccgaccgtctggccgaggcgtgcgccgagtggctgcaccagcaggtgcgcaaagagcactggggttacgccaaggatgaagccctcgataacgaggcgctgatcaaagagcagtattccggcatccgccctgcccccggctacccggcgtgcccggatcacaccgagaaggccaccctgttcgccctgctcgaccctgaagcacaggaaatgcgcgccggccgcagcggtgtgttcctcaccgagcactacgcgatgttcccggcggcagccgtcagcggctggtacttcgcccatccgcaggcgcagtacttcgccgtgggcaaggtcgacaaggatcaggtgcagagctacacctcgcgcaaaggccaggaactgagcctgaccgagcgctggctggcacccaatctgggctacgacaactga

SEQ ID NO: 26 - protein, 1236 aa, Pseudomonas fluorescens
MSDRSVRLQALKQALKERILILDGGMGTMIQSYKLEEQDYRGKRFADWPSDVKGNNDLLVLTRPDVIGGIEKAYLDAGADILETNTFNATQISMADYGMEELVYELNVEGARLARKVADAKTLETPDKPRFVAGVLGPTSRTCSLSPDVNNPGYRNVTFDELVENYTEATKGLIEGGADLILIETIFDTLNAKAAIFAVQGVFEELGFELPIMISGTITDASGRTLSGQTTEAFWNSVAHAKPISVGLNCALGARELRPYLEELSDKASTHVSAHPNAGLPNEFGEYDELPVDTAKVIEEFAQSGFLNIVGGCCGTTPGHIEAIAKAVAGYAPRQIPDIPKACRLSGLEPFTIDRSSLFVNVGERTNITGSAKFARLIREDNYTEALEVALQQVEAGAQVIDINMDEGMLDSKKAMVTFLNLIAGEPDISRVPIMIDSSKWDVIEAGLKCIQGKGIVNSISMKEGVEQFIHHAKLCKRYGAAVVVMAFDEAGQADTEARKKEICKRSYDILVNEVGFPPEDIIFDPNIFAVATGIEEHNNYAVDFINACAYIRDELPYALSSGGVSNVSFSFRGNNPVREAIHSVFLLYAIRAGLTMGIVNAGQLEIYDQIPQELRDAVEDVILNRTPEGTDALLAIADKYKGDGSVKEAETEEWRGWDVNKRLEHALVKGITTHIVEDTEESRQSFARPIEVIEGPLMSGMNIVGDLFGAGKMFLPQVVKSARVMKQAVAHLIPFIELEKGDKPEAKGKILMATVKGDVHDIGKNIVGVVLGCNGYDIVDLGVMVPAEKILQVAKEQKCDIIGLSGLITPSLDEMVHVAREMQRQDFHLPLMIGGATTSKAHTAVKIEPKYSNDAVVYVTDASRAVGVATQLLSKELKAGFVQKTREEYIDVRERTANRSARTERLSYAAAIAKKPQFDWATYTPVKPTFTGTRVLDNIDLNVLAEYIDWTPFFISWDLAGKFPRILEDEVVGEAATALYKDAREMLTKLIDEKLISARAVFGFWPANQVHDDDIELYGDDGKPMARLHHLRQQIIKTDGKPNFSLADFVAPKDSEVTDYVGGFITTAGIGAEEVAKAYQDAGDDYNSIMVKALADRLAEACAEWLHQQVRKEHWGYAKDEALDNEALIKEQYSGIRPAPGYPACPDHTEKATLFALLDPEAQEMRAGRSGVFLTEHYAMFPAAAVSGWYFAHPQAQYFAVGKVDKDQVQSYTSRKGQELSLTERWLAPNLGYDN

SEQ ID NO: 27 - DNA, 3705 bp, Pseudomonas aeruginosa
  CDS (1)..(3702): RPA01772
atgtccagcccgctcaccgatcgcagcgcccgcctgcaagccctccagcacgccctcagggaacgtatcctgatcctcgatggcggcatgggcaccatgatccagagctacaagctggaagaggccgactaccgcggcgagcgcttcgccgactggccgagcgacgtgaaaggcaacaacgacctcttgctgctgagccgcccggacgtgatccaggccatcgagaaggcctacctcgacgccggcgccgacatcctcgagaccaacaccttcaacgccacccaggtgtcccaggccgactacggcatgcagtcgctggcctacgaactcaacgtcgaaggggcgcgcctggcccgccaggtggcggacgcgaagaccgccgagaccccggacaagccgcgtttcgtcgccggcgtgctcggcccgaccagccgcacctgctcgatttccccggacgtgaacaaccccggctaccgcaacgtcaccttcgacgaactggtggagaactacgtcgaggcgacccgaggcctgatcgaaggcggcgccgacctgatcctgatcgagaccatcttcgacaccctcaacgccaaggcggcgatcttcgccgtccagggcgtgttcgaggaactcggcgtggagctgccgatcatgatctccggaaccatcaccgacgcctccggccgcaccctgtcgggccagaccaccgaggccttctggaactcggtgcggcatgcccggccgatctcggtaggcctgaactgcgccctcggcgccaaggaattgcggccgtacatcgaggaactgtcgaccaaggccgacactcatgtctcggcccaccccaacgccggcctgccgaacgccttcggcgaatacgacgaatcgccggcggaaatggccgtggtggtcgaggaattcgccgccgccggcttcctcaatatcgtcggcggctgctgcggcaccaccccggcgcacatcgaggcgatcgccaaggcagtggccaagtacccgccgcgggccatcccggagattccccgggcctgtcgcctgtccggcctggagccgttcaccatcgaccgcagctcgctgttcgtcaacgtcggcgagcgcaccaacatcaccggttcggccaagttcgcccggctgatccgcgaggaaaactacgcggaagctctcgaggtcgcccagcagcaggtggaagccggcgcccaggtgatcgacatcaacatggacgaaggcatgctggactcgaaggcggccatggtcaccttcctcaacctgatcgcctccgagcccgacatctcgcgcgtgccgatcatgatcgactcctccaagtgggaagtgatcgaggccggcctgaagtgcatccagggcaagggcatcgtcaactcgatctcgatgaaggaaggcgtcgaggccttcaagcaccatgcccgcctgtgcaagcgctacggcgccgcggtggtggtgatggccttcgacgaggacggccaggccgacacccaggcgcgcaaggaagaaatctgcaagcgctcctacgacatcctggtcgacgaagtcggcttcccaccggaagacatcatcttcgatgcgaacatcttcgccatcgccaccggcatcgaggaacacaacaactacgcggtcgatttcatcaacgcctgcgcctacatccgcgacaacctcccctacgccctgagctcgggcggggtgtccaacgtgtccttctcgttccgcggcaacaacccggtacgcgaggcgatccactcggtgttcctctactacgcgatccgcaacggcctgaccatgggcatcgtcaacgccggccagctggaaatctacgacgagattccgaaagcgctgcgcgaccgggtcgaggacgtggtgctcaaccgcacgcccgaggccaccgaggccctgctggcgatcgccgacgactacaagggcggcggcgcggtcaaggaggccgaggacgaggaatggcgcagctacagcgtcgagaagcgcctcgagcatgcgctggtcaagggcatcaccacctggatcgtcgaggacaccgaggaatgccgccagcagtgtgcgcgtcccatcgaggtcatcgaaggtccgctgatgtccgggatgaacgtggtcggcgacctgttcggcgccggcaagatgttcctcccgcaggtggtcaagtccgcgcgagtgatgaagcaggcggtggcccacctgattcccttcatcgaggcggagaaaggcgacaagccggaagccaagggcaagatcctgatggccacggtgaagggcgacgtgcacgacatcggcaagaacatcgtcggcgtggtgctcggctgcaacggctatgacgtggtcgacctcggcgtgatggtgccggcggagaagatcctgcagaccgccatcgccgagaaatgcgacatcatcggcctgtctggcctgatcacgccgtcgctggacgagatggtccacgtcgccaaggaaatgcagcggcagaatttccagttgccgctgatgatcggcggcgccactacctcgaaggcgcataccgcggtgaagatcgatccgcagtacagcaacgacgcggtggtctacgtcaccgacgcctcgcgcgcggtaggcgtggccaccagcctgctgtccaaggagctgaaggccgactacgtggcccgcacccgcgccgactacgcggtggtccgcgaacgcacggccaaccgcagcgcccgcaccgagcggctgagctacgaacaggcgatcgccaacaagccggcgttcgactgggccggctaccaggcgccgacgccttccttcaccggcgtcagggtgctcgacgagatcgacctcgcggtgctcgccgagtacatcgactggacgccgttcttcatttcctgggacctggccggcaagtacccgcgcatcctcaccgacgaggtggtcggcgaggccgccacctcgttgttcaacgacgcccaggcgatgctgaagaagctgatcgacgagaagctgatcaaggcccgcgcggtgttcggcttctggccggccaaccaggtcgagcacgacgacctggaggtctacggcgccgatggcgagaccctcgccaccctgcaccacctgcggcagcagacgatcaagccggacggcaagccgaacctgtcgctggccgatttcgtcgcgccgaaggaaagcggcgtgcgcgactacatcggcggcttcatcaccaccgccgggatcggcgccgaggaagtggccaaggcgtacgaagccaagggcgacgactacaacagcatcatggtcaaggcgctcgccgaccgcctcgccgaagcctgcgccgagtggctgcacgagcgggtgcgcaaggagtactggggctacgcccgcgacgaacacctcgacaacgaggccttgatcaaggagcaatacgtcggcatccgcccggcaccgggctacccggcctgccccgaccataccgagaaaggcactctgttcgaactgctcgatccgcagggcctgtccggcgtcagcctgaccgagcactacgcgatgttcccggccgcggcggtcagcggttggtatttcgcccacccgcaggcgcagtacttcgcggtcggcaagatcgacaaggaccaggtggaacgctacagccagcgcaagggccaggaagccagcgtcagcgagcgctggctggcgccgaaccttggctacgatgactga

SEQ ID NO: 28 - protein, 1234 aa, Pseudomonas aeruginosa
MSSPLTDRSARLQALQHALRERILILDGGMGTMIQSYKLEEADYRGERFADWPSDVKGNNDLLLLSRPDVIQAIEKAYLDAGADILETNTFNATQVSQADYGMQSLAYELNVEGARLARQVADAKTAETPDKPRFVAGVLGPTSRTCSISPDVNNPGYRNVTFDELVENYVEATRGLIEGGADLILIETIFDTLNAKAAIFAVQGVFEELGVELPIMISGTITDASGRTLSGQTTEAFWNSVRHARPISVGLNCALGAKELRPYIEELSTKADTHVSAHPNAGLPNAFGEYDESPAEMAVVVEEFAAAGFLNIVGGCCGTTPAHIEAIAKAVAKYPPRAIPEIPRACRLSGLEPFTIDRSSLFVNVGERTNITGSAKFARLIREENYAEALEVAQQQVEAGAQVIDINMDEGMLDSKAAMVTFLNLIASEPDISRVPIMIDSSKWEVIEAGLKCIQGKGIVNSISMKEGVEAFKHHARLCKRYGAAVVVMAFDEDGQADTQARKEEICKRSYDILVDEVGFPPEDIIFDANIFAIATGIEEHNNYAVDFINACAYIRDNLPYALSSGGVSNVSFSFRGNNPVREAIHSVFLYYAIRNGLTMGIVNAGQLEIYDEIPKALRDRVEDVVLNRTPEATEALLAIADDYKGGGAVKEAEDEEWRSYSVEKRLEHALVKGITTWIVEDTEECRQQCARPIEVIEGPLMSGMNVVGDLFGAGKMFLPQVVKSARVMKQAVAHLIPFIEAEKGDKPEAKGKILMATVKGDVHDIGKNIVGVVLGCNGYDVVDLGVMVPAEKILQTAIAEKCDIIGLSGLITPSLDEMVHVAKEMQRQNFQLPLMIGGATTSKAHTAVKIDPQYSNDAVVYVTDASRAVGVATSLLSKELKADYVARTRADYAVVRERTANRSARTERLSYEQAIANKPAFDWAGYQAPTPSFTGVRVLDEIDLAVLAEYIDWTPFFISWDLAGKYPRILTDEVVGEAATSLFNDAQAMLKKLIDEKLIKARAVFGFWPANQVEHDDLEVYGADGETLATLHHLRQQTIKPDGKPNLSLADFVAPKESGVRDYIGGFITTAGIGAEEVAKAYEAKGDDYNSIMVKALADRLAEACAEWLHERVRKEYWGYARDEHLDNEALIKEQYVGIRPAPGYPACPDHTEKGTLFELLDPQGLSGVSLTEHYAMFPAAAVSGWYFAHPQAQYFAVGKIDKDQVERYSQRKGQEASVSERWLAPNLGYDD

SEQ ID NO: 29 - DNA, 3714 bp, Nitrosomas europeae
  CDS (1)..(3711): RNE01732
atgacaatgcatgaacgtgctgatttgctgaaacggttgcttgccgagcgtatcctgatgctcgacggtgccatgggtacgatgatccagagctacaaactgaccgagtcggattatcggggggaacgttttgccgattttccgcatgatctcaaaggcaacaatgatctgctctgcctgaccagaccggaagtcatccgctccattcatcgtgcttacctcgaagccgggtcggatatcatcgagaccaacacgttcaactcgaatgcgccgtcgatggcggactaccacatgcaggatctggtgtatgaactgaatgtggcgggtgcgcgcctggcgtgtgaggaagcgcgggcaatggaaacgcagcaacctgaccggccccgtttcgttgccggtgtgatcgggcctaccaccaaaacggcttcactctcaccggatgtcaatgatcctggattccgggccattaccttcgatgatctggtggaaagctataccgagtcggtgcgcgggctgatcgacggaggcgcggatattctgctggtcgaaaccatttttgacaccttgaatgccaaagccgcattgtttgccatcgatcagtatttcgaaacgcatggattacgtctgccggtgatgatatcggtcacgattaccgatgcttcgggacgtaatctttccgggcagacaccggaagctttctggaattcggtacggcatgcacgtccgctttcggtgggaatcaactgcgcgttgggtgcggagttgatgcgcccctacgtggaagagttgtccaatgtggctgaggttttcaccagcgcccatcccaatgccggcttgcctaatcccttggcggaaaccggttatgacgaaacgccggaatataccgcccgtctgatcaaggattttgcgcaatccgggttcgtcaacattgtcggcggctgctgtggcactacaccgaaacatatcgcggccattgcagaagcggtacgggacatccctccgcgcccactgcccgatattcctaaaaaactgaggctttccggcctcgagccgctcaatatcgatgaacattccctgttcgtaaacgtgggtgaacgtaccaatgtcaccggctccaaggcatttgcccggctgattctcaatggcggttatgctgaagggctggtgatcgcgcgcagccaggtggagaacggcgcacaaatcatcgatatcaacatggatgaagcgatgctggattcacagaaggcgatggtgacctttctgaatctgctcgctgccgaaccggatatcagccggctgccgatcatgctcgattccagcaaatggtcggtgatcgaagccggactgaaatgtgtccagggtaaggcggtcatcaattccatcagcctcaaggaaggtgaagcggagtttttacatcatgccaggctggcgcgtcgttatggggccgcggtgattgtcatggctttcgacgaaaccgggcaggccgataccttgcagcgcaaggtggaaatctgcacgcgttgttaccatacactgattgaacaggccgatttcccacccgaggatatcattttcgaccccaatatttttgccattgctacgggtatcgaagaacacagtaactatgcagtggattttatcgaggcgacacacgtcatccggcaaacgctgccttatgccaaagtcagcgggggtgtttccaatgtttccttctcgttccggggtaacgaaccgatccgcgaagccattcataccgcattcctgtatcacgcggtcaaggcaggcatgaccatgggtatcgtcaacgcaggtcagcttggggtttattccgacattccgcccgatctgctggaacatgtcgaggatgtactgctgaaccggcggcctgatgcaaccgaacgtctggtggagtttgcggaacatttcaagggacagaaaaaggagcagatcgaagatctgtcctggcgtgatgaaccggtgcggcagcgcctgattcatgcactggtcaggggtatcagcacctacatcgtcgaggataccgagctcgtccggcaggagatcgacagccagggaggcaagccgatcgaggtgatcgaaggcccgctcatggacggcatgaatgtagtgggggatctgtttggcgcaggcaagatgtttctgccacaggtggtcaagtcggcacgggtgatgaagcaggcggttgcctatctgttgccgtacatcgaggcagagaaaaaaatttccggcgacagcaagcccaagggcaaggtggtgatcgctaccgtcaaaggggatgtgcatgatattggcaagaatatcgtttccgtcgtgttgcagtgtaataactttgaagtcatcaacatgggggtgatggtccccagtgcacagattctggaaacagcacgccgtgaacaggtcgatatgatcggtctgtccggcctgatcaccccttcgctggaagaaatggcgcatgttgcccgggaaatggagcgtgaacaattcaccgttccgctgctgatcggtggcgccaccacttcgcggatgcatacggcagtcaaaatcgcaccccattacggtggggtgaccgtatgggtgccggatgccagccgggcagtcggggtgtgcagcaatctgatgtcacaggatctgcgtgatgactatgtccggcaggtcaaggccgagcaggagaagagccgggtgcagcaccgcaacaagaaagggccatccaagctcctcactttcgaggaagcccgggccaacgcactcaagacggattgggctcgttatactccaccagctccggatttcctggggttgcgcaccctcaacaactatccgctggaaacactggtgccgcacatcgactggacacctttcttccaggcatgggaactgcacgggcgctatcctgccatcctgcaggatgaactcgtcggggaagcagccagcaatctgtttcgcgatgcccagaatatgctcagaaaaatcgtcgagcaaaaatggctcaccgccaacgccgttatcggcctgttcccggccaataccgtcaatggagatgatatcgagatttatgctgaccgtagtcgcagtcaggtgatcatgacctggcacaccttgcggcagcagacggccaaaccggcagggcgtcccaatctggcactggctgatttcattgcgccgcgtgaaaccggactggacgataccatcggtttgtttgccgtcagcgccggtttcggtatcgatgaacgcatacgcgcttttgaagctgcaaacgatgattacagtgccatcatcctgaaagcactggctgatcgtctggctgaagcgtttgcagaacacatgcatgcacgggtgcggcgagaattctggggctatgtgaaagatgagagtctggacaatgaacagttgatcgacgagcaatacctgggaatccgtccagcaccaggttatcctgcctgccctgatcataccgaaaaggggccattgttcgctctgctggaagcggaaaaacgcagcggaatcgtcataacggaatcatttgccatggtgccgactgcagcagtatccggcttctatctctcttaccctgaatccagctattttgctgttggaaaaatcggaaaagatcaggtcgaggattatgcaagacgcaaagggtggacgctggaagaagcagaaaggtggcttgcgcctgtcttggcgtatgagcgttaa

SEQ ID NO: 30 - protein, 1237 aa, Nitrosomas europeae
MTMHERADLLKRLLAERILMLDGAMGTMIQSYKLTESDYRGERFADFPHDLKGNNDLLCLTRPEVIRSIHRAYLEAGSDIIETNTFNSNAPSMADYHMQDLVYELNVAGARLACEEARAMETQQPDRPRFVAGVIGPTTKTASLSPDVNDPGFRAITFDDLVESYTESVRGLIDGGADILLVETIFDTLNAKAALFAIDQYFETHGLRLPVMISVTITDASGRNLSGQTPEAFWNSVRHARPLSVGINCALGAELMRPYVEELSNVAEVFTSAHPNAGLPNPLAETGYDETPEYTARLIKDFAQSGFVNIVGGCCGTTPKHIAAIAEAVRDIPPRPLPDIPKKLRLSGLEPLNIDEHSLFVNVGERTNVTGSKAFARLILNGGYAEGLVIARSQVENGAQIIDINMDEAMLDSQKAMVTFLNLLAAEPDISRLPIMLDSSKWSVIEAGLKCVQGKAVINSISLKEGEAEFLHHARLARRYGAAVIVMAFDETGQADTLQRKVEICTRCYHTLIEQADFPPEDIIFDPNIFAIATGIEEHSNYAVDFIEATHVIRQTLPYAKVSGGVSNVSFSFRGNEPIREAIHTAFLYHAVKAGMTMGIVNAGQLGVYSDIPPDLLEHVEDVLLNRRPDATERLVEFAEHFKGQKKEQIEDLSWRDEPVRQRLIHALVRGISTYIVEDTELVRQEIDSQGGKPIEVIEGPLMDGMNVVGDLFGAGKMFLPQVVKSARVMKQAVAYLLPYIEAEKKISGDSKPKGKVVIATVKGDVHDIGKNIVSVVLQCNNFEVINMGVMVPSAQILETARREQVDMIGLSGLITPSLEEMAHVAREMEREQFTVPLLIGGATTSRMHTAVKIAPHYGGVTVWVPDASRAVGVCSNLMSQDLRDDYVRQVKAEQEKSRVQHRNKKGPSKLLTFEEARANALKTDWARYTPPAPDFLGLRTLNNYPLETLVPHIDWTPFFQAWELHGRYPAILQDELVGEAASNLFRDAQNMLRKIVEQKWLTANAVIGLFPANTVNGDDIEIYADRSRSQVIMTWHTLRQQTAKPAGRPNLALADFIAPRETGLDDTIGLFAVSAGFGIDERIRAFEAANDDYSAIILKALADRLAEAFAEHMHARVRREFWGYVKDESLDNEQLIDEQYLGIRPAPGYPACPDHTEKGPLFALLEAEKRSGIVITESFAMVPTAAVSGFYLSYPESSYFAVGKIGKDQVEDYARRKGWTLEEAERWLAPVLAYER

SEQ ID NO: 31 - DNA, 3774 bp, Bordetella pertussis
  CDS (1)..(3771): RBP00104
  unsure 205 .. 205: All occurrences of n indicate any nucleotide
  unsure 277 .. 277: All occurrences of n indicate any nucleotide
gtgccttatccccgtatccccttcccgctgtccgcctacacgcatggcggcgagttcgtccgccaactggacaagcgcatcctgatcctggatggtgccatgggcacgatgatccagcgctacaagctgggcgaggccgatttccgtggcgagcgcttcgccgagcaccacaaggatctcaagggcgacaacgaactgctgtcgntggtgcgcccggacgtgatcgcggaaatccaccggcagtacctcgaggccggcgccgacgtgatcgagaccnacaccttcggcgccacgtcgatcgcccagggcgattacgacctgccggagctggcctacgagatgaacctggagtcggcccgcctggcgcgcgccgcctgcgacgcctacagcacgcccgagcatccgcgcttcgtggccggggcgctggggccgcagcccaagaccgcgtccatctcgcccgacgtcaacgacccgggggcgcgcaacgtcaccttcgacgagctgcgcgcggcctatgtcgagcagctcaatggcctgctcgacggcggcatcgacatcgtcctgatcgaaaccatcttcgatacgctcaacgccaaggcggccatcttcgccgtcgaggaagcgttcgaggcgcgcggcgtgcgcctgccggtgatgatttcgggcaccgtgaccgatgcgtcgggccgcatcctgtccggccagaccgtcgaggcgttctggaactcggtgcgccatgcgcggccggtcaccatcggcctgaactgcgcgctgggcgcggcgctgatgcgtccgtatgtggccgagctgtccaagatctgcgacacctatgtgtgcgtctatcccaacgccggcctgcccaatcccatggccgagacgggctttgacgaaacgccggccgatacctcggccctgctggaagagttcgcccaggccgggctggtcaacatggccggcggctgttgcggcaccacgcccgagcacatccgcgccatcgccggcaaggtggccgcgctgacgccgcgcgcggtgcccgaggtgccggtcaagacccgcctgtcgggcctggaggcgctcaacatcgacgacgagactctgttcgtcaacgtgggcgagcgcaccaacgtgacgggcagcaagatgttcgcccgcctggtccgcgaggagaaatacgacgaggcgctggccgtggcgcgccagcaggtcgagaacggggcccagatcatcgacgtcaacatggacgaggcgatgctggactcggtggcctgtatgcaccgcttcctcaacctgatcgcgtccgagcccgacatcgcgcgggtgccggtgatgatcgacagttccaagtgggaagtgatcgagaccggcctgaagtgcgtgcagggcaaggccgtggtcaactcgatctccatgaaggaaggcgaggagccgttccgccatcatgcgcgcctgtgccgccgctacggcgcggccatggtggtcatggccttcgacgaacaggggcaggccgactcgctggagcgccgcaaggaaatctgcggccgcgcctaccgtatcctggtcgaggaagagggcttcccgcccgaggacatcatcttcgatcccaacgtgttcgcggtggccaccggcatcgacgaacacaatcactacgccgtcgatttcatcgaaggcgcgcgctggatccgcgcgaacctgccgcatgcccgcatttcgggcggcatctcgaacgtcagcttctcgttccgcggcaacgagccgatgcgcgaggcgatccataccgtcttcctgtactacgccatcgaggccggcctgacgatgggcatcgtcaacgcgggccagctgggcgtatatgccgacctggcgccgcacctgcgcgacctggtcgaggacgtcatcctggaccgccccgagccggtgggccgcagcgactcggccgacgagcgctcgcccaccgaacggctggtgcagtttgccgagaccgtcaagggctcgggcgcgaagaaggaagaagacctgacctggcgcaccggctcggtcgagcagcgcctggcgcatgccctggtgcacggcatcaccaccttcatcgtcgaggacaccgaggaagtgcgccagcaggtcgccgcgcgcggcgggcgcaccatcgaagtgatcgaaggtccgctgatggacggcatgaacgtggtcggcgacctgttcggcgcgggcaagatgttcctgccgcaagtggtgaagtcggcgcgcgtgatgaagcaggcggtggcgcacctgattcccttcatcgaggaggaaaagcgccagatcgcggccgcgggcggcgatgtgcgcgccaagggcaagatcgtgatcgccaccgtcaagggcgacgtgcacgacatcggcaagaacatcgtgtcggtggtcttgcagtgcaataacttcgaagtcgtgaacatgggcgtgatggtgccgtgcgcccagatcctgcagaaggccaaggacgagaacgccgacatgatcggcctgtccggcctgatcacgcccagcctcgaagagatggcctacgtggcttcagaaatgcagcgcgacccctatttccgcgagcgcgccatgccgctgatgataggcggggcgaccaccagccgggtccatacggcggtcaagatcgcgcccaactacgacggtccggtgatctacgtgcccgatgccagccgttcggtcggcgtggcgaccagcctcatgtccgaccaggccccggcctatttggcggagctggcgcaggagtacgaggatgtgcgccgctgccatgccaaccgcaaggcggtgccgctggtgtcgctggccgaggcgcgcgcggcgcgcccgcagatcgactggtccggctaccagccgccgcgccccaagttcctgggccggcgcgccttcaagagctacgacctggccgagatcgcgcgctatatcgactgggggccgttcttccagacgtggagcctgttcggcccgttccccgccatcctggacgacaaggtggtgggcgagcaggcgcgcaaggtctacgaggaaggccaggccatgctcaagcgcatcatcgacgggcgctggctgaccgccagcggcgtggtcggcttctatccggccaaccgcgtcaatgacgaagacatcgaggtctacgcggacgagacgcgcagcgagatgctgttcacctaccgcaacctgcgccagcagggcgtcaagcgcgaaggcgtcagcaacaagtgcctggccgactacatcgcgccgcgcgacagcggcctgctcgactacatcggcatgttcgccgtgaccgcgggcctgggcatcgagaagaaagaggccgagttccaggcggcgctggacgactactccagcatcatgctgaagtcgctggccgaccggctggccgaggcgttcgccgaatgcatgcacgcgcgcgtgcgccgcgacctgtggggctacgcggcggacgaggcgctgtccaacgatgagctgatcgccgagaagtacagcggcatccggccggcgcccggctatccggcctgcccggagcacgtggtcaagacggacctgttccgcgtgctggacgccgccgacgtcggaatggagctgaccgacagctacgccatgttcccggcctccagcgtctcggggttctatttcagccaccccgagtcgcagtatttcaacgtgggcaacatcggcgccgaccagctggccgactacgtggcgcgcagcggccgcgccgaagaggacgtgcgccgcaccctggcgccgaacctgggctag

SEQ ID NO: 32 - protein, 1257 aa, Bordetella pertussis
  unsure 69 .. 69: All occurrences of Xaa indicate any amino acid
  unsure 93 .. 93: All occurrences of Xaa indicate any amino acid
VPYPRIPFPLSAYTHGGEFVRQLDKRILILDGAMGTMIQRYKLGEADFRGERFAEHHKDLKGDNELLSXVRPDVIAEIHRQYLEAGADVIETXTFGATSIAQGDYDLPELAYEMNLESARLARAACDAYSTPEHPRFVAGALGPQPKTASISPDVNDPGARNVTFDELRAAYVEQLNGLLDGGIDIVLIETIFDTLNAKAAIFAVEEAFEARGVRLPVMISGTVTDASGRILSGQTVEAFWNSVRHARPVTIGLNCALGAALMRPYVAELSKICDTYVCVYPNAGLPNPMAETGFDETPADTSALLEEFAQAGLVNMAGGCCGTTPEHIRAIAGKVAALTPRAVPEVPVKTRLSGLEALNIDDETLFVNVGERTNVTGSKMFARLVREEKYDEALAVARQQVENGAQIIDVNMDEAMLDSVACMHRFLNLIASEPDIARVPVMIDSSKWEVIETGLKCVQGKAVVNSISMKEGEEPFRHHARLCRRYGAAMVVMAFDEQGQADSLERRKEICGRAYRILVEEEGFPPEDIIFDPNVFAVATGIDEHNHYAVDFIEGARWIRANLPHARISGGISNVSFSFRGNEPMREAIHTVFLYYAIEAGLTMGIVNAGQLGVYADLAPHLRDLVEDVILDRPEPVGRSDSADERSPTERLVQFAETVKGSGAKKEEDLTWRTGSVEQRLAHALVHGITTFIVEDTEEVRQQVAARGGRTIEVIEGPLMDGMNVVGDLFGAGKMFLPQVVKSARVMKQAVAHLIPFIEEEKRQIAAAGGDVRAKGKIVIATVKGDVHDIGKNIVSVVLQCNNFEVVNMGVMVPCAQILQKAKDENADMIGLSGLITPSLEEMAYVASEMQRDPYFRERAMPLMIGGATTSRVHTAVKIAPNYDGPVIYVPDASRSVGVATSLMSDQAPAYLAELAQEYEDVRRCHANRKAVPLVSLAEARAARPQIDWSGYQPPRPKFLGRRAFKSYDLAEIARYIDWGPFFQTWSLFGPFPAILDDKVVGEQARKVYEEGQAMLKRIIDGRWLTASGVVGFYPANRVNDEDIEVYADETRSEMLFTYRNLRQQGVKREGVSNKCLADYIAPRDSGLLDYIGMFAVTAGLGIEKKEAEFQAALDDYSSIMLKSLADRLAEAFAECMHARVRRDLWGYAADEALSNDELIAEKYSGIRPAPGYPACPEHVVKTDLFRVLDAADVGMELTDSYAMFPASSVSGFYFSHPESQYFNVGNIGADQLADYVARSGRAEEDVRRTLAPNLG

SEQ ID NO: 33 - DNA, 3645 bp, Chlorobium tepidum
  CDS (1)..(3642): RCL00420
gtgctcgacggggccatgggcaccatgatccagaggcatggcctcgacgaacaggactaccggggcgagcgtttcgcttcgcatgaccatccgctgaagggcaacaacgaccttcttgtcatcacccggcccgacatcatccgttcgatccactgcgacttcctcgacgcgggtgcggacatcatcgagacctgcaccttcaacgccaacccgatctcgcagtcggactaccagttgcaggacttgacccgcgagctgaacgtggcggcggcaaagatagcccgctcggcagcggacgagttcaccgcaaagactcccgacaagccgcgtttcgtggccggttccatcggaccgaccaacaagacgctctcgctctcgccggacgtgaacaaccccggcttccgcgccgtcaccttccaggagatggtcgataactacactgcccagctcgaaggcttgcacgagggcggtgtcgatctcttgctcgtcgagacggtgttcgacacactgaactgcaaggcggcgctctacgctatcgaggagtacgcggtgaaaaccggctggcaggtgcccgtgatggtctccggcacggtggtggacgcgagcggccgcaccctctccggccaaaccaccgaggcgttctggatttcgatttcgcacatgccgagtctgctctcggtcggcctgaactgcgcactcggctccaagcagatgcgccccttcatcgaggcgctctcgaacatcgccgaaagctacgtcagcgtctatcccaacgcgggcctgccgaatgagttcggcgagtacgacgactcccccgagtacatggccgcgcagatcgcgggcttcgccgaatcaggcttcgtgaacatcgtcggcggctgctgcggcaccacgccgacgcacatccgcgccattgccgaagcggtcaagactctcccgccgagaaagcgccccgccaacaagcacgtgctgaggctctccggcctcgaaccgctcgtggttgacgaaaccaccggcttcatcaacgtcggcgagcgcaccaacgtcaccggttcgcgcaagttcgcccgcctcatcaaggaggccaattacgacgaagcgctctccattgcccgccagcaggtcgagaacggcgcgcaggtgatcgacgtgaacctcgacgaaggaatgctcgactccgaaaaggtgatcgtcgaattcctgaacctcatcgcctccgagcctgagatcgccaaggtgccggtgatgatcgactcgtcgaaatggtcggtcatcgaaaacggcctgcgctgcacccagggcaagagcatcgtcaactcgatcagcctcaaggagggcgaggagctgttcaaggagcgcgctcgcaagatcatgcaatacggcgcggcggcggtggtcatggccttcgacgagcagggccaggccgacagcctgcaccgccgcatcgagatttgcagccgcgcctacaaaattctcaccgaagaggtgggcttcccgccggaggacatcatctttgacccgaacgtgctgaccgtggccaccggcatcgacgagcacaacaactacgcgctcgacttcatcgaaagcgtgcgctggatcaagcagaacctgccgcacgcgaaggtctccggcggcatcagcaacgtttcgttctccttccgcggcaacgagccggtgcgcgaggcgatgcacaccgcgttcctctaccacgccatccacgccggtctcgacatgggcatcgtcaacgccgcccagcttggcatctacgaagagatcgacccggagcttcttgtctatgtcgaggacgtgctgctgaaccgccgcgacgacgccaccgagcggctcgtggcgttcgctgaaacgatccgcgacggcggcgaaaaggccgaggccaagaacgccgaatggcgcaacgccccggtcgaggagcggctgaaacacgcgctcgtcaagggcatcgttgactacatcgacgaggacaccgaagaggcccgccagctctacccgagtccgctggaggtgatcgaggggccgctcatgaacggcatgaaccacgtcggcgacctcttcgccgaaggcaagatgttcctgccacaggtggtcaaaagcgcccgcgtcatgaagcgctcggtagctgcgctgattccctatatcgaggaggagaagtcgaaaaactgcgacacgagcgccaaagccaaggtgctgctcgccacggtgaagggcgacgtgcacgacatcggcaagaacatcgtgtcggtggtgcttgcctgcaacaacttcgacgtgatcgacatcggcgtcatgatgccatgcgacaagattctcgaagcgctggcagaacacaagcccgacgtgctcggcctctccggcctcatcaccccgtcgctcgaagagatggcgcacgtggccaaagagatggagcggctcggcatgaacattccgctcatcatcggcggcgcgaccacctcgaaggtgcacacggcggtgaaactcgcgccctgctaccccagcggcgcggtagtacacgtgctcgacgcctcgcgcagcgtgccggtggtcagcaacctctgcaaccccgcccagcgcgacagctatatcgcggcgctgaaggatgagcaggaggcgatgcgcaagagccacgccgagcgcatggcggcaaaaaagtacgtctcgctcgacgccgcccgcgacaaccgcctcaccattgactgggaggccgaaaccatcgacaagcccgcccagactggcgtcaccgtgctggaggatgtcaccgtcggcgcgctccgcccgtatatcgactgggcamccttcttctggagctgggagctgcacggcgtctatccgcagattctggaggatgaaaaggtcggcgaggaggcaaccaaactcttcaacgacgccaccgctctgctcgaccggatcgacagcgaaaagctgctcggcatcaaaggcgtggcgggcatcttcccggccaacagcatcggcgacgacatcttcgtctatgcggatgacgagcgctcgataatccgcaccgtgctgcacaccctgcgccagcaaggcgaaaagcacggcgaagcgaacctcgcgctggcggacttcgtggccccgcgcgaaagcggcgtcaacgactggatcggctgcttcaccgtaaccgccggactcggcatccagaatttgctcgacgagttcacagcagagaacgacgactaccaccgcatcatgacacaggcgctcgccgaccgactggccgaagcgttcgcagagatgctgcacgaaaaggtgcgccgcgaactctggggctacgcgcccggcgaaatcctcggcaacgaagagctgatcgccgaaaagtaccgaggcatccgccccgcccccggctaccccgcctgcccggatcacaccgaaaaggcaatcatcttcgacctgctcaacgctgaagcggccaccggcgtcacgctgacggaaactttcgcgatgaaccccgcagcctcagtctgcggcctctacttcgccaacccggcctcgaaatacttcgtactcggcaagattggtaaggatcaggtcgaagactacgccaaccgcaaagggctggaagtagcagaagccgagaagtggctcgcgccctcgctgaactacgatccagcgtaa

SEQ ID NO: 34 - protein, 1214 aa, Chlorobium tepidum
  unsure 936 .. 936: All occurrences of Xaa indicate any amino acid
VLDGAMGTMIQRHGLDEQDYRGERFASHDHPLKGNNDLLVITRPDIIRSIHCDFLDAGADIIETCTFNANPISQSDYQLQDLTRELNVAAAKIARSAADEFTAKTPDKPRFVAGSIGPTNKTLSLSPDVNNPGFRAVTFQEMVDNYTAQLEGLHEGGVDLLLVETVFDTLNCKAALYAIEEYAVKTGWQVPVMVSGTVVDASGRTLSGQTTEAFWISISHMPSLLSVGLNCALGSKQMRPFIEALSNIAESYVSVYPNAGLPNEFGEYDDSPEYMAAQIAGFAESGFVNIVGGCCGTTPTHIRAIAEAVKTLPPRKRPANKHVLRLSGLEPLVVDETTGFINVGERTNVTGSRKFARLIKEANYDEALSIARQQVENGAQVIDVNLDEGMLDSEKVIVEFLNLIASEPEIAKVPVMIDSSKWSVIENGLRCTQGKSIVNSISLKEGEELFKERARKIMQYGAAAVVMAFDEQGQADSLHRRIEICSRAYKILTEEVGFPPEDIIFDPNVLTVATGIDEHNNYALDFIESVRWIKQNLPHAKVSGGISNVSFSFRGNEPVREAMHTAFLYHAIHAGLDMGIVNAAQLGIYEEIDPELLVYVEDVLLNRRDDATERLVAFAETIRDGGEKAEAKNAEWRNAPVEERLKHALVKGIVDYIDEDTEEARQLYPSPLEVIEGPLMNGMNHVGDLFAEGKMFLPQVVKSARVMKRSVAALIPYIEEEKSKNCDTSAKAKVLLATVKGDVHDIGKNIVSVVLACNNFDVIDIGVMMPCDKILEALAEHKPDVLGLSGLITPSLEEMAHVAKEMERLGMNIPLIIGGATTSKVHTAVKLAPCYPSGAVVHVLDASRSVPVVSNLCNPAQRDSYIAALKDEQEAMRKSHAERMAAKKYVSLDAARDNRLTIDWEAETIDKPAQTGVTVLEDVTVGALRPYIDWAXFFWSWELHGVYPQILEDEKVGEEATKLFNDATALLDRIDSEKLLGIKGVAGIFPANSIGDDIFVYADDERSIIRTVLHTLRQQGEKHGEANLALADFVAPRESGVNDWIGCFTVTAGLGIQNLLDEFTAENDDYHRIMTQALADRLAEAFAEMLHEKVRRELWGYAPGEILGNEELIAEKYRGIRPAPGYPACPDHTEKAIIFDLLNAEAATGVTLTETFAMNPAASVCGLYFANPASKYFVLGKIGKDQVEDYANRKGLEVAEAEKWLAPSLNYDPA

SEQ ID NO: 35 - DNA, 3777 bp, Deinococcus radiodurans
  CDS (1)..(3774): RDR02645
atgagccatcacccagaagcgtcggcttccgccaatccgtccatcaaccatcaaccgtccaccatcaccgaggccgcccgccagcgcatcctgattctcgacggcgcctggggtacgcagcttcagcgagccaacctcaccgaagcggacttccgctgggacgaagccgaccccacgcggatgtaccggggcaacttcgacctgctgcaactgaccaagcctgacgtgattcgcgccgtgcaccgcgcctatttcgaggccggagcggacatcgccagcaccaataccttcaactccacgaccatctcgcaggcggattacggcaccgaggcactggcctacgccatgaaccgcgagggggcaaggctggcccgcgaagtcgccgacgagttcgaggcgcgcgacggcaaaaagcgctgggtggcggggagtgtcggtcccaccaaccgcaccgcgaccctttctcccgacgtggagcggcccgagttccgcaacgtgacctacgacgacctcgtggcggcgtactcggaggccatcaccgggttgatggaaggtggcgcggacctgctgctcattgaaacggtgtttgacacgctgaacgccaaagccgcgctgtttgccgcgcaggacgtgttcgcggcgcaggggcgcgagctgccggtcatgctctcgggcaccatcaccgacgcctcgggccgcacgctgagcgggcagacgcccgaagccttcgcggtgagcaccgagcacgccggcctcttttcgctgggcctgaactgcgcgctgggcgccgacctgctgcggccccacctgcgcgcaattgcggcgaacacggaggcgctggtgtcggttcaccccaacgcgggcctccccaacgccttcggggaatacgacgaaacgcccgaacacacggcggcggtgctggccgacttcgcccgcgaggggctggtcaacatcgtgggcggctgctgcggcaccacacccgagcacatcaaagcgattgcggaggcggtgaaggacattcccccgcgccaggcgctgcaactgccgccttacctgcgcctcagcggcctcgaagccttcaccctgacgccggaaaccaacttcgtcaacgtgggcgagcgcaccaacgtgaccggcagtcccaagttcagcaaggcgattctggccggcgactacgacgcagggctcaagattgcccgccagcaggtgacgaacggcgcgcaaatcgtggacatcaacttcgacgaggggatgctcgacggcgaaggagcgatggtcaagttcctcaacctgctcgccggggagccggacatctcgcgcgtgcccctgatgctcgactcgtccaagtgggagattctggaagcggggctgcggcgggtgcagggcaaggcagtcgtcaactccatctcgctcaaggacggcgaggccaggtttctggaacgcgcccggctgctgcggcgctacggggcggcggcggtggtcatggccttcgacgaacagggacaggccgacaacctcgcccgacgccgggagattctgggccgcgcgtataggctgctgaccgagcaggcggactttccgccgcaggacatcattttcgaccccaacgtgctgaccgttgccaccggcatcgaggaacacgaccgctacgcgctggactttatcgaggcgacgcgctggattaaagaaaacctgccggcggcgaaggtgtcgggcgggatttccaacgtctcgttcagcttccggggcaacaaccacgtgcgcgaggcgatgcacgcggtgtttctgtaccacgccatccgcgccgggctggacatgggcatcgtgaacgcggggatgctggcggtgtacgaggacatcgagccggagctgcgcgaggccgtcgaggacgtcattctggctcgccgtccggacgccaccgagcgtttgctgacgctggccgaccgctacaaggacatcaagcgcgaaagtgccgcccagagcgcctggcgcgacctgccggtgcaggaacggctgcggcacgcactggtgcagggcgtcgccgaccacgtggatgaggacgccgaggccgcctatcaggaactcggcagcccgctggccgtcatcgaaggcccgctgatggacggcatgaacgtggtgggcgacctcttcggcgcggggaaaatgttcctgccgcaggtggtcaaatccgcccgcgtgatgaaaaaggcagtggcctacctcacgccctatctggaagcggagaaggcggaaagctccagcaagggcaaggtactgctggcgaccgtcaagggcgatgtgcacgacatcggcaagaacatcgtgggcgtggtgctcgcctgcaacggctatcaggtgaccgacctcggcgtgatggtgccgggcgagaagattctggacgaagccgagcggctcggtgccgacgtgatcggtctgagcgggctgattacgccttccttagacgaaatggtgaacgtggcccgcgagatgacgcgccggggcgtgaaaactccactgctgatcggcggcgcgacgaccagccgggcgcacacggcggtcaagattgacccggcctacgacgggacggtagtgcacgtgctggacgccagccgcgccgtgaccgtgaccaacgacctgctgaccgacgaggccgcctacgctgggcgcgtgcagggcgagtatgacaccttgcgcgagcgccacggcgagcggcaggtgcggctgattgcgctggcagaagcccgcgcccgcgccccgcaactgagtgccgccgtgccccccgcgccgcacgatctgggccgtcaggtggtcgaacagcccattgccgagctgctgcccttcatcgactggacgccctttttcatcgcctgggagatgaagggcatctacccgggcatcctgaccgaccctctgcgtggcgaggaggcccgcaagctgtttgccgacgcgcaggcgctgctggagcaggttatcgccgacggctcgctgcgggcgcgcggcgtcatcgggctgtggcccgcgcacggcgacgacatcgtgctggacgatgcggcgatggggcgtggcgagacgctggatttcgagacgcacgaactcgccgccgggcgcgagccgctgccgaacatgccgcgcctgcacacgctgcggcagcagcgcgaccagaccacgccgaacactgcgctggctgactttgtggcggaaggaggcgaccacatcggcgccttcgccacggccatcttcggcgccgaggagttggcgcagcagttcgaggcgcagcacgacgactacaactcgattctggtcaaggcggtggccgaccgactggccgaggcctttgccgagaagctgcaccgcgacgtgcgcgtgcggcactggggttacgccgagggcgaggcgctcgacaacaccgacctcatcaaggagcgctatcagggcatccgccctgcgcccggctaccccgcgcagcccgaccacaccgagaaacgcaccctgtttgagctgctggacgcggaaagcatcggcctgcgcctcaccgagtcgtgtgccatgaccccggcggcggcggtgtcggggctgtacttcgcgcatccggaggcccgttatttcgcagtgggccgcatcgggcgcgaccaggtggagaactacgccgcccgtaagggttggactgtgcaggaagccgagcgctggctggggccgctgctggcgtacagcgccgggccggggccagaagcaagccagaaagccctcggcgcagagctgacaggagcgcaatcgtga

SEQ ID NO: 36 - protein, 1258 aa, Deinococcus radiodurans
MSHHPEASASANPSINHQPSTITEAARQRILILDGAWGTQLQRANLTEADFRWDEADPTRMYRGNFDLLQLTKPDVIRAVHRAYFEAGADIASTNTFNSTTISQADYGTEALAYAMNREGARLAREVADEFEARDGKKRWVAGSVGPTNRTATLSPDVERPEFRNVTYDDLVAAYSEAITGLMEGGADLLLIETVFDTLNAKAALFAAQDVFAAQGRELPVMLSGTITDASGRTLSGQTPEAFAVSTEHAGLFSLGLNCALGADLLRPHLRAIAANTEALVSVHPNAGLPNAFGEYDETPEHTAAVLADFAREGLVNIVGGCCGTTPEHIKAIAEAVKDIPPRQALQLPPYLRLSGLEAFTLTPETNFVNVGERTNVTGSPKFSKAILAGDYDAGLKIARQQVTNGAQIVDINFDEGMLDGEGAMVKFLNLLAGEPDISRVPLMLDSSKWEILEAGLRRVQGKAVVNSISLKDGEARFLERARLLRRYGAAAVVMAFDEQGQADNLARRREILGRAYRLLTEQADFPPQDIIFDPNVLTVATGIEEHDRYALDFIEATRWIKENLPAAKVSGGISNVSFSFRGNNHVREAMHAVFLYHAIRAGLDMGIVNAGMLAVYEDIEPELREAVEDVILARRPDATERLLTLADRYKDIKRESAAQSAWRDLPVQERLRHALVQGVADHVDEDAEAAYQELGSPLAVIEGPLMDGMNVVGDLFGAGKMFLPQVVKSARVMKKAVAYLTPYLEAEKAESSSKGKVLLATVKGDVHDIGKNIVGVVLACNGYQVTDLGVMVPGEKILDEAERLGADVIGLSGLITPSLDEMVNVAREMTRRGVKTPLLIGGATTSRAHTAVKIDPAYDGTVVHVLDASRAVTVTNDLLTDEAAYAGRVQGEYDTLRERHGERQVRLIALAEARARAPQLSAAVPPAPHDLGRQVVEQPIAELLPFIDWTPFFIAWEMKGIYPGILTDPLRGEEARKLFADAQALLEQVIADGSLRARGVIGLWPAHGDDIVLDDAAMGRGETLDFETHELAAGREPLPNMPRLHTLRQQRDQTTPNTALADFVAEGGDHIGAFATAIFGAEELAQQFEAQHDDYNSILVKAVADRLAEAFAEKLHRDVRVRHWGYAEGEALDNTDLIKERYQGIRPAPGYPAQPDHTEKRTLFELLDAESIGLRLTESCAMTPAAAVSGLYFAHPEARYFAVGRIGRDQVENYAARKGWTVQEAERWLGPLLAYSAGPGPEASQKALGAELTGAQS

SEQ ID NO: 37 - DNA, 3642 bp, Clostridium acetobutylicum
  CDS (1)..(3639): RCA01265
cttatgaattcttcactaaagaatttgttaaataacaaaattttagttttagatggtgctatgggaacatgtattcaatcctttaatctagatgaaggcgactttaaaggttccttatcttgtacatgtcattccaatcaaaaaggaaacaatgatgttttaaatttaaccaagccagaaataataaaagaaatccacaagagataccttgaagctggcgcagatataatagaaacaaacacttttaacgctactgaaatatcacaaaaagattataatatgcaagataaaatatatgatattaattttaagggggcaaaactcgcaaaggaagcttgtacttactacacaaaactaaatcctaataagcctagatttgctgctggttctattgggcctacaaatagaactgcttctctatctccagatgttgaaaatcctggttttagaaatgtaacctttgatgagctatgtaatgcctataaacatcaaatagaggctctaatagatggaggtgtagaccttcttttaattgaaactatatttgatactttaaacgctagagcagcaatctttgcagcagaaacagtatttgaaaataaaaaaataaaacttcctattataatttcagggacaatagctgataaaagtggaagaatattatccggtcaaactcttgacgcttttgcagaaagtttaaaaaacgaaaatataattgctatagggcttaattgttcctttggtgctgaagaacttataccttttataaaaagactctctgaaacacaaaatagatatatatcctttcatccaaacgcaggacttccaaactcccttggtgaatatgaagaactgccagaggaaactgctagcattgtaaaaaaattagcacttgaaggacatttaaatatagttggaggctgctgtggcactacaccagaacatataagagcaataagcagcgtagttaaaggcatttctccaagaaaagttccaaacttggaacccaaaacaatttacagcggactagaaaacataaaaattgataagaacagtaacttcataaatataggcgaaagaacaaatgtagcgggctcaagaaaattcgcaaggcttatacgtgaaaaaaattatgaggaggctctaaccattgcaagacatcaggttgaaaatggtgcccaaattatagatataaattttgatgatgcacttttagatgctcgctctgaaatggaaacatttttaagacttattgcaagtgaacctgaaatatcaaaagttccagttatgatagactcctctaattttgaagttttaaaagttggattaaagtctattcaaggtaaagccatagtaaattccataagtcttaaggttggagaagaaaagttcattgaagaggcaaaatttataaagaactttggcgctggcgtagttgtaatggcctttgacgaagaaggtcaagcagctacttatgaaagaaaaattgaaatctgcaagagagcttatactattctcacagaaaaagttgagtttccacctgaaaatataatatttgatccaaatatactatctatagcgacaggaattgaagaacatgacaactatgcagttaattacataaaagctgttaaatggataaaagagaatctaccatacgctaaagtcagcggtggagttagcaacctctccttttcttttaggggtaatgacgcaataagaagagctatgcattctgttttcctttaccatgcaataaacgctggaatggatatgggtattgttaatccagcaatgattgatttatatgacgatatagataaggatcttctcgaaaaggttgagaatgttgtactaaataaatcatctaacgcttctgaatcattactagaatttgctcaaacgtataaaaagacgactgaaaccttagaaaagcacgaggatgaatggcgacaaaaaagcccaagtgaaaggttgagttatgctttagttaaaggaaatgttgaatttattgaagaagatatagaagaagcaagaaaagagtatacaaatgcacttgaaattatagaggttcctttaatgaatggaatgaaaaaagtgggtaaactttttggagagggaaaaatgtttcttcctcaagtagtaaaaagtgctagagttatgaaaaaggctgttgaatgtcttcttccctatataaacgaagaaaagtctaaaaatcacaataaaagtgctggtaaggttgtatttgcaactgttaaaggcgatgttcatgacataggcaaaaatatcgtatctgtagttctttcctgcaacaattttgaagttatagatttaggagtaatggttccccctgaaaccatacttgaaacggcaaaacgtgaaaatgcagatatcattgctttaagtggtttaattacaccttctcttaatgaaatggcttatgtagctgaagaaatgaaaaggcttaattttgatataccacttatggtgggtggtgctgctacctcaaaaactcacacagctttaaaactagctacgaaatataaatatgtagtacacagtactgatgcttcagatgctgttaccgtagccaaaaatctaatgagtgaaaacaaatttactttcttagaaaaattaaatgaagagtattctaaaataagagagaccttctctactaataagattgaacttatctccattcaaaacgcaagaaaaaacagatttactattgactggaataaaactaaaataactgaacctaaatttgtcggtataaaaaaattacaagctgtacctataaatgaattaagaaagtatatagattggactttcttctttacgtcttgggatatgggaatgaattaccccaaaataatgaaagatcctaaatacggagctgaagctcaaaaactctttaaggatgccaatgaaatgcttgatttattgcaaaaagaaaatttaatcacttgtaatggagtttttggaatattcccagctaattctgttaatgatgatatagaaatctacactgataaaggaactgtaaccataaatactcttcgtcagcagcagatacttaaagacagcgattataaagctctatctgattatatcgctccaaagggtattggcatcaaagattatataggtggttttattgtaactgctggaataggtgcaaaggaatattccgataaattaaagaaaaaatgcgacgattatggagctactatgcttaaacttatatgcgatagacttgcagaggccttttcagaacttcttcacctaagggtaagaaaagaatactggggatactctcaagatgaaaacttatccttagaaaaacttcttaaaggaagttacagagggataaaaccagctattggatatccttctattcccgatcactctgaaaaagcaaagttatttgatttacttttaggtaaaacttcaataggagtggaattgacggaaagttatatgatgaatccaacttcaagtgtatgcggtttgtattttgcaaatgaacgagcaaaatactttaatataaataaaataggaaaagatcaacttgaggactatgctgttcgaagtaataaagacattaatgaaataaaaaaattattagatactctgttataa

SEQ ID NO: 38 - protein, 1213 aa, Clostridium acetobutylicum
LMNSSLKNLLNNKILVLDGAMGTCIQSFNLDEGDFKGSLSCTCHSNQKGNNDVLNLTKPEIIKEIHKRYLEAGADIIETNTFNATEISQKDYNMQDKIYDINFKGAKLAKEACTYYTKLNPNKPRFAAGSIGPTNRTASLSPDVENPGFRNVTFDELCNAYKHQIEALIDGGVDLLLIETIFDTLNARAAIFAAETVFENKKIKLPIIISGTIADKSGRILSGQTLDAFAESLKNENIIAIGLNCSFGAEELIPFIKRLSETQNRYISFHPNAGLPNSLGEYEELPEETASIVKKLALEGHLNIVGGCCGTTPEHIRAISSVVKGISPRKVPNLEPKTIYSGLENIKIDKNSNFINIGERTNVAGSRKFARLIREKNYEEALTIARHQVENGAQIIDINFDDALLDARSEMETFLRLIASEPEISKVPVMIDSSNFEVLKVGLKSIQGKAIVNSISLKVGEEKFIEEAKFIKNFGAGVVVMAFDEEGQAATYERKIEICKRAYTILTEKVEFPPENIIFDPNILSIATGIEEHDNYAVNYIKAVKWIKENLPYAKVSGGVSNLSFSFRGNDAIRRAMHSVFLYHAINAGMDMGIVNPAMIDLYDDIDKDLLEKVENVVLNKSSNASESLLEFAQTYKKTTETLEKHEDEWRQKSPSERLSYALVKGNVEFIEEDIEEARKEYTNALEIIEVPLMNGMKKVGKLFGEGKMFLPQVVKSARVMKKAVECLLPYINEEKSKNHNKSAGKVVFATVKGDVHDIGKNIVSVVLSCNNFEVIDLGVMVPPETILETAKRENADIIALSGLITPSLNEMAYVAEEMKRLNFDIPLMVGGAATSKTHTALKLATKYKYVVHSTDASDAVTVAKNLMSENKFTFLEKLNEEYSKIRETFSTNKIELISIQNARKNRFTIDWNKTKITEPKFVGIKKLQAVPINELRKYIDWTFFFTSWDMGMNYPKIMKDPKYGAEAQKLFKDANEMLDLLQKENLITCNGVFGIFPANSVNDDIEIYTDKGTVTINTLRQQQILKDSDYKALSDYIAPKGIGIKDYIGGFIVTAGIGAKEYSDKLKKKCDDYGATMLKLICDRLAEAFSELLHLRVRKEYWGYSQDENLSLEKLLKGSYRGIKPAIGYPSIPDHSEKAKLFDLLLGKTSIGVELTESYMMNPTSSVCGLYFANERAKYFNINKIGKDQLEDYAVRSNKDINEIKKLLDTLL

SEQ ID NO: 39 - DNA, 3954 bp, Caulobacter_crescentus
  CDS (1)..(3951): RCO02271
atgaccgatctctccatccgcgccaaccgcgtcgccgccctgaaggccgccgccaaggagcgtattctcattctcgacggctcctggggcgtgatgttccagaagaaggggctgaccgaggccgactaccgcgccgagcgcttcgccgcctacaacggccagatgaagggcaataacgacatcctgtgcctgacgcggcccgatctcgtggccgagctgcacgacgcctatttcagcgccggcgccgacatctccgagaccaacaccttctcgggcaccaccatcgcccaggccgactatcatctgggtgaacaggatgtctgggacatcaacctggaaggcgccaagatcggccgctcggtggccgaccgctggaacgcgcagaatcccgaccgcccgaagttcatcgccggctcgatggggccgctgaacgtcatgctgtcgatgtcgtcggacgtgaacgatccgggcgcgcgcaaggtgaccttcgaccaggtctacgaggcctatcgccagcaggtggatgcgctttaccagggcggggtcgatctcttcctgatcgagaccatcaccgacaccctgaactgcaaggccgcgatcaaggcgatcctggactggcgcgacgagggccacgaggagctgccgatctggatcagcggcaccatcaccgatcgctcgggccgcaccctgtcgggccagacggccgaggcgttctggaacagcgtcaagcacgccaagccgttcgcagtgggcttcaactgcgccctgggcgcggatttgatgcgtccgcacatcgccgagatggcccgtatcgccgacaccctggtcgcagcctatcccaacgccggcctgcccaacgccatgggccagtacgacgaggagccgcacgagaccggccacgccctgcacgagtgggccaaggacggcctcgtcaacatcctgggcggctgctgcggcacgacaccggaccacatccgtcacgtcgccgacgaggtgcgcggcgtgacgccgcgccagatccccgagcgccccaaggccatgcgcctggcgggcctcgaaccgttcgagttggcttagtggctacggccgcaaattcccttctccccttgcgggagaaggtgtcgccgaaggcgacggatgaggggtctcgccggcccttcaaccgctgtctcgcggcggcgacgttcttcaacccctcatccgacccgctgcgcgggccaccttctcccgcaaggggagaagggatgactgctattggatcctgaaatgcgccccgtcttcgtcaacatcggtgagcgcaccaacgtcaccggctcggccaagttcaagaagctgatcgtcgaagggaactatcccgaggcgctgtcggtcgcgcgccagcaggtcgaggccggggcccaggtcatcgacgtgaacatggacgagggtctgctggacagccagcaggccatggtcaccttcctgaatctgatggcggccgagcccgacatcgcgcgcgtgccggtgatgatcgacagctccaagtgggaggtgatcgaggcgggcctgaagtgcgtacaaggcaaggcgatcgtcaactcgatcagcctgaaggaaggcgaggaaaagttcctcgaacaggccacgctctgcctgcgctatggcgcagccgtggtggtcatggccttcgacgaggttggccaggccgacaccgaaaagcgcaaggtcgagatctgtacgcgggcctacaacacgctcgtggacaaggtcggcttcccgcccgaggacatcatcttcgaccccaacatcttcgccgtggcgacggggatcgaggagcacgacaactacgccgtcgacttcatcgaggccacgcggcgcatcaagcagatgttgccctatgcgcgggtgtcgggcggggtgtcgaacgtctcgttcagcttccggggcaatgagccggtgcgccgggcgatccactcggtgttcctgtaccacgccatcaacgccggcatggacatgggcatcgtcaacgccggcgacctgccggtctatgacgacatcgatccggccctgcgcgaggccgtcgaggacgtgatcctcaaccggccgcagcgcgatccggtgatgaccaacaccgagcgcctggtcgagatggccccgcgctataagggcgagaaggggcagcagcaggtcgccaacctggagtggcgaaagggcacggtgaacgagcgcctgacccatgctctcgttcacggcatcaccgagttcatcgagcaggacaccgaggaggcgcgcctggccgccgagcgccccttgcacgtgattgaaggcccgctgatggacggcatgaacgtcgtcggcgacctgttcggcgcgggcaagatgttcctgccccaggtggtgaagtcggcccgcgtgatgaagcaggccgtcgcctggctgatgccgttcatggaggccgagaaggaaggccaggagcgcaaggccgccggcaaggtgctgatggccaccgtcaagggcgacgtccacgacatcggtaagaacatcgtcggcgtcgtgctgcagtgtaacaactacgaggtcgtggacctgggtgtcatggtgcccgccgaccgcatcctggacgaagccaagaagcacaaggtcgacatgatcggcctgtcgggcctgatcaccccctcgctggacgagatggtgttcgtggccgccgagatggagcgccagggctttgatatcccgctgctgatcggcggcgccaccaccagccgcacccacaccgcggtgaagatcgagccggcctatcgccggggtccgacgacctatgtcgtcgacgccagccgcgccgtgggcgtggtctcgggcctgctgtcggaaggcgagcgtgaccggatcatcgccgagacccgcgccgagtatgtgaaggtccgcgagcaatacgcgcgcggccagaccaccaaggcccgcgcctcgatccaggaggcccgcaagcgcgccttcgccattgactggaagggctatgcgccgcccaagcccgccttcatcggcacgcgggtgttcgagccgtcgctggccgagctggtcccgttcatcgactggtcgccgttcttcgccagctgggagctgatcggccgcttcccgcagatcctggaggacgacgtggtcggccaggccgccaccgacctctaccgcgacgcccgcgccatgctggacaaggtggtcgaggaaaagtggttcggggccaagggcgtgatcggcttctggccggcccaggcccagggcgacgacatcgtgctctataccgacgagacccgcgtggccgagttctcgcgcctgcacacccttcgccagcagatggacaagggcgccgacaagagcggcgaggccaaggccaatgtcgccctgtcggacttcgtcgcgccgatcgggcagggggctgactatgtcggcggcttcgccgtcaccgcaggccatggcgaggacgagatcgtcgccaagttcaaggcggccggcgacgactacaacgccatcatggcctcggccctggccgaccgcctggccgaagccttcgccgagtggctgcactacaaagcccgtgtcgagctgtggggctacgccgccgacgaggacgccgacgtcgagcgcctgatcgccgaaaagtaccagggcatccgccccgcgcccggctatccggcccagcccgaccacaccgagaaaggtacgctgttcaagctgctcgacgccgaggcggccaccggtctgcagctgaccgagagctacgccatgacccctggcgcggcggtctccggcctgttcttcagccaccgccaggcgcactatttcggggtcggcaagatcgacgccgaccaggtcgaggactacgcccgccgcaagggctgggatatggagacggccgagcgctggctgtcgccgatcctgaactacgatccgctagcgcgggcgcgcggggcggcggcttag

SEQ ID NO: 40 - protein, 1317 aa, Caulobacter_crescentus
  unsure 359 .. 359: All occurrences of Xaa indicate any amino acid
  unsure 416 .. 416: All occurrences of Xaa indicate any amino acid
MTDLSIRANRVAALKAAAKERILILDGSWGVMFQKKGLTEADYRAERFAAYNGQMKGNNDILCLTRPDLVAELHDAYFSAGADISETNTFSGTTIAQADYHLGEQDVWDINLEGAKIGRSVADRWNAQNPDRPKFIAGSMGPLNVMLSMSSDVNDPGARKVTFDQVYEAYRQQVDALYQGGVDLFLIETITDTLNCKAAIKAILDWRDEGHEELPIWISGTITDRSGRTLSGQTAEAFWNSVKHAKPFAVGFNCALGADLMRPHIAEMARIADTLVAAYPNAGLPNAMGQYDEEPHETGHALHEWAKDGLVNILGGCCGTTPDHIRHVADEVRGVTPRQIPERPKAMRLAGLEPFELAXWLRPQIPFSPCGRRCRRRRRMRGLAGPSTAVSRRRRSSTPHPTRCAGHLLPQGEKGXLLLDPEMRPVFVNIGERTNVTGSAKFKKLIVEGNYPEALSVARQQVEAGAQVIDVNMDEGLLDSQQAMVTFLNLMAAEPDIARVPVMIDSSKWEVIEAGLKCVQGKAIVNSISLKEGEEKFLEQATLCLRYGAAVVVMAFDEVGQADTEKRKVEICTRAYNTLVDKVGFPPEDIIFDPNIFAVATGIEEHDNYAVDFIEATRRIKQMLPYARVSGGVSNVSFSFRGNEPVRRAIHSVFLYHAINAGMDMGIVNAGDLPVYDDIDPALREAVEDVILNRPQRDPVMTNTERLVEMAPRYKGEKGQQQVANLEWRKGTVNERLTHALVHGITEFIEQDTEEARLAAERPLHVIEGPLMDGMNVVGDLFGAGKMFLPQVVKSARVMKQAVAWLMPFMEAEKEGQERKAAGKVLMATVKGDVHDIGKNIVGVVLQCNNYEVVDLGVMVPADRILDEAKKHKVDMIGLSGLITPSLDEMVFVAAEMERQGFDIPLLIGGATTSRTHTAVKIEPAYRRGPTTYVVDASRAVGVVSGLLSEGERDRIIAETRAEYVKVREQYARGQTTKARASIQEARKRAFAIDWKGYAPPKPAFIGTRVFEPSLAELVPFIDWSPFFASWELIGRFPQILEDDVVGQAATDLYRDARAMLDKVVEEKWFGAKGVIGFWPAQAQGDDIVLYTDETRVAEFSRLHTLRQQMDKGADKSGEAKANVALSDFVAPIGQGADYVGGFAVTAGHGEDEIVAKFKAAGDDYNAIMASALADRLAEAFAEWLHYKARVELWGYAADEDADVERLIAEKYQGIRPAPGYPAQPDHTEKGTLFKLLDAEAATGLQLTESYAMTPGAAVSGLFFSHRQAHYFGVGKIDADQVEDYARRKGWDMETAERWLSPILNYDPLARARGAAA

SEQ ID NO: 41 - DNA, 3759 bp, Rhodobacter  capsulatus
  CDS (1)..(3756): RRC01731
atgctgacccagaccctgccccgatctgcggcctttgccgcaattgaggcgctttcgcgccagcggatcttgatccttgacggggcgatgggcacgcagatccagcagcttggcctgagcgaggacgattttctgggccacggctcgggctgcgcctgccgccatgccaccgatcatccgcaaaagggcaacaacgacctgctggtgctgacccagccgcaagcgatcgaggagatccatttccgctatgcgatggcgggggcggatatcgtcgagacgaacaccttttcggccaccaccatcgcgcaggccgattacgggctggaaagcgcggtgttcgacctgaacgccgcgggggcgcgggtggcgcgggcggcgatggaccgcgccgaggccaccgacggacggcgccgcttcgttgcgggggcggtggggccgacgaaccgcaccgcctcgctctcgcccgatgtgaacgacccgggctttcgcgccgtcaccttcgacgatctgcgcacggcctatggccagcaggtgcgcggtctgatcgcggggggcgccgatatcctgctgatcgagacgatctttgacacgctgaacgccaaggcggcgattttcgcctgtttcgaagcctttgccgaacggggcgagcggctgccggtgatgatttccggcacgatcaccgatgcctcggggcgcacattgtcggggcagacgccgaccgcgttctggcattcggtggctcatgcccggccctttaccgtggggctgaactgcgcgctgggcgccagtgcgatgcgtccgcatctggcggaactggcgggcgtcgccccctgcgcgatctgcgcctatcccaatgccgggctgcccaatgcctttggccaatatgacgaaacccccgaccggaccgccgcgcaggtggccgaatttgcccgcgaagggctggtcaatgtcgtgggcggttgctgcggcaccacccccgatcacatccgcgccatcgcggaagccgtgaaacctttcccgccgagggccctgccaagccgttatctgcgcctttcggggcttgagccctttaccctgacgcccgacattcccttcgtgaacatcggcgagcgcacgaatgtcaccggctcggcccggttccgcaagatgatcgtcgcccgcgactatgccgccgcgctggatgtcgcccgcgatcaggtggaaaacggcgcgcagatccttgacatcaacatggacgaggggctgatcgacagtcaggcggcgatggtcgccttcctcaacctcttggccgccgagcccgacattgcccgggtgccggtgatgatcgacagctcgaaatgggaggtgatcgaggccgggctgaaatgcgtgcagggcaagcccgtcgtcaattcgatcagcctgaaggagggcgaggagatcttccgccatcacgcggcgctgtgtctggcctatggcgcggcggtcgtcgtgatggcctttgacgaagaggggcaggccgacagtttcgcccgaaagaccagcatctgcgcccgcgcctatcgcattctggtcgaggagatcggctttccgcccgaagacatcatctttgacccgaacgtctttgccgtcgccacgggcatcgaagaacacgacaattacggcgttgatttcatcgaggccgctcgctggatccgggccaacctgccgcatgcccatgtctcgggcggggtgtcgaacctgtccttcagctttcgcggcaacgaacccgtgcgcgcggcgatgcatgcggtgtttctttaccacgccatccgcgccgggatggatatggggatcgtcaatgccgggcagctggtggtctatgaccagatcgaccccgagctgcgccaggcctgcgaggatgtggtgctcaaccgccagcccaaatcgggcggcaccgcgaccgagcggatgctggaggtggccgagcgcttccgcggcggcgcgcgcgaggaaaagacccgcgatctggcctggcgcgactggccggtggaaaagcggctcgaacatgcgctggtcaatggcatcaccgaattcatcgaggccgataccgaagccgcaaggcttctggccgaacgcccgctgcatgtgatcgaagggccgctgatggcggggatgaatgtcgtcggtgatctgttcggcgcgggcaagatgttcctgccacaggtggtgaaatcggcgcgcgtgatgaaacaggccgtcgccgttctgctgccctacatggatgccgaaaaggccgcgcgcggcggcgaggggcgcgaaaccgcgggcaagatcctgatggccacggtcaagggcgatgtgcatgacatcggcaagaacatcgtcggcgtcgtgctggcctgcaacaattacgacatcgtcgacctgggcgtgatggtgccgccgcaaaagatcctggaagtggcgcgggccgaaaaggtcgatgcgatcgggctttccgggctgatcacgccaagcctggacgagatggtgcatctggccgcggaaatggagcgcgagggctttgacattccgctgctgatcggcggggcgaccacgtcgaaagtgcatacggcggtgaagatcgcccccgcctacagccgcgggcaggcggtttatgtgctcgatgccagccgggccgtgggggtggtgggggcgcttttgagcccgaaccagaaggtcgattacgcggcgcagatccgcgcggactatgcgcagatcgccgcccgtcatgcccgcgacgaggccgccaaggtgcggctgcctttggccgcggcccgggccaatgcgctgcggctcgactggtcgggctatgccgtgcccgcgccgcaattccttggcccgcgcgtgatcgacgactgggatctggccgaagtggcgcggtatatcgactggacgcccttcttccatgcctgggaattgaagggggtctatccgcggattctcgatgacgccgaaaagggcgaagcggcgcgggcacttttcgccgatgcccaggcgatgctggcgcagatcattgccgaacgctggttcaccccgcgcgccgtggtggggttctggcccgcgcaggcggtgggcgacgatatccggctttacaccgacgagagccggaccgaagacctcgccactttcttcaccctgcgccagcagaccggcaagcgcgaaggccgcccgaatgtggctttggccgatttcgtcgcgcctgcgggcacggtgcccgattatctgggcggcttcgtggtcaccgcgggccccgaggaagccgagatcgccgcgcggttcgaagctgccaatgaccattattccgcgatcctggtcaaggcgctggccgaccgctttgccgaagccctggccgaggccctgcatcagcgggtgcggcgcgactattggggctatgcgcccgaagaaagcttcgcccccgatcagctggtgggcgagccctatcgcggcatccgcccggcgcccggctatccggcccagcccgaccacacggaaaagctgacgctgttccggctgcttggggccgaggccgcgaccggcgtgcatctgaccgacagcatggcgatgtggcccggctcttcggtctcggggctctatatcggccatccggaggcctattatttcggtctggcccggatcgagcaggatcaggccgccgattacgccgcccgcaagggcatggccttggccgaggtgcagcgctggctggccccggtgctggggtcggccgcgcccgccgccgctgcggtggccgcgtga

SEQ ID NO: 42 - protein, 1252 aa, Rhodobacter  capsulatus
MLTQTLPRSAAFAAIEALSRQRILILDGAMGTQIQQLGLSEDDFLGHGSGCACRHATDHPQKGNNDLLVLTQPQAIEEIHFRYAMAGADIVETNTFSATTIAQADYGLESAVFDLNAAGARVARAAMDRAEATDGRRRFVAGAVGPTNRTASLSPDVNDPGFRAVTFDDLRTAYGQQVRGLIAGGADILLIETIFDTLNAKAAIFACFEAFAERGERLPVMISGTITDASGRTLSGQTPTAFWHSVAHARPFTVGLNCALGASAMRPHLAELAGVAPCAICAYPNAGLPNAFGQYDETPDRTAAQVAEFAREGLVNVVGGCCGTTPDHIRAIAEAVKPFPPRALPSRYLRLSGLEPFTLTPDIPFVNIGERTNVTGSARFRKMIVARDYAAALDVARDQVENGAQILDINMDEGLIDSQAAMVAFLNLLAAEPDIARVPVMIDSSKWEVIEAGLKCVQGKPVVNSISLKEGEEIFRHHAALCLAYGAAVVVMAFDEEGQADSFARKTSICARAYRILVEEIGFPPEDIIFDPNVFAVATGIEEHDNYGVDFIEAARWIRANLPHAHVSGGVSNLSFSFRGNEPVRAAMHAVFLYHAIRAGMDMGIVNAGQLVVYDQIDPELRQACEDVVLNRQPKSGGTATERMLEVAERFRGGAREEKTRDLAWRDWPVEKRLEHALVNGITEFIEADTEAARLLAERPLHVIEGPLMAGMNVVGDLFGAGKMFLPQVVKSARVMKQAVAVLLPYMDAEKAARGGEGRETAGKILMATVKGDVHDIGKNIVGVVLACNNYDIVDLGVMVPPQKILEVARAEKVDAIGLSGLITPSLDEMVHLAAEMEREGFDIPLLIGGATTSKVHTAVKIAPAYSRGQAVYVLDASRAVGVVGALLSPNQKVDYAAQIRADYAQIAARHARDEAAKVRLPLAAARANALRLDWSGYAVPAPQFLGPRVIDDWDLAEVARYIDWTPFFHAWELKGVYPRILDDAEKGEAARALFADAQAMLAQIIAERWFTPRAVVGFWPAQAVGDDIRLYTDESRTEDLATFFTLRQQTGKREGRPNVALADFVAPAGTVPDYLGGFVVTAGPEEAEIAARFEAANDHYSAILVKALADRFAEALAEALHQRVRRDYWGYAPEESFAPDQLVGEPYRGIRPAPGYPAQPDHTEKLTLFRLLGAEAATGVHLTDSMAMWPGSSVSGLYIGHPEAYYFGLARIEQDQAADYAARKGMALAEVQRWLAPVLGSAAPAAAAVAA

SEQ ID NO: 43 - DNA, 3798 bp, Homo sapiens
  CDS (1)..(3795): RHS24705
atgtcacccgcgctccaagacctgtcgcaacccgaaggtctgaagaaaaccctgcgggatgagatcaatgccattctgcagaagaggattatggtgctggatggagggatggggaccatgatccagcgggagaagctaaacgaagaacacttccgaggtcaggaatttaaagatcatgccaggccgctgaaaggcaacaatgacattttaagtataactcagcctgatgtcatttaccaaatccataaggaatacttgctggctggggcagatatcattgaaacaaatacttttagcagcactagtattgcccaagctgactatggccttgaacacttggcctaccggatgaacatgtgctctgcaggagtggccagaaaagctgccgaggaggtaactctccagacaggaattaagaggtttgtggcaggggctctgggtccgactaataagacactctctgtgtccccatctgtggaaaggccggattataggaacatcacatttgatgagcttgttgaagcataccaagagcaggccaaaggacttctggatggcggggttgatatcttactcattgaaactatttttgatactgccaatgccaaggcagccttgtttgcactccaaaatctttttgaggagaaatatgctccccggcctatctttatttcagggacgatcgttgataaaagtgggcggactctttccggacagacaggagagggatttgtcatcagcgtgtctcatggagaaccactctgcattggattaaattgtgctttgggtgcagctgaaatgagaccttttattgaaataattggaaaatgtacaacagcctatgtcctctgttatcccaatgcaggtcttcccaacacctttggtgactatgatgaaacgccttctatgatggccaagcacctaaaggattttgctatggatggcttggtcaatatagttggaggatgctgtgggtcaacaccagatcatatcagggaaattgctgaagctgtgaaaaattgtaagcctagagttccacctgccactgcttttgaaggacatatgttactgtctggtctagagcccttcaggattggaccgtacaccaactttgttaacattggagagcgctgtaatgttgcaggatcaaggaagtttgctaaactcatcatggcaggaaactatgaagaagccttgtgtgttgccaaagtgcaggtggaaatgggagcccaggtgttggatgtcaacatggatgatggcatgctagatggtccaagtgcaatgaccagattttgcaacttaattgcttccgagccagacatcgcaaaggtacctttgtgcatcgactcctccaattttgctgtgattgaagctgggttaaagtgctgccaagggaagtgcattgtcaatagcattagtctgaaggaaggagaggacgacttcttggagaaggccaggaagattaaaaagtatggagctgctatggtggtcatggcttttgatgaagaaggacaggcaacagaaacagacacaaaaatcagagtgtgcacccgggcctaccatctgcttgtgaaaaaactgggctttaatccaaatgacattatttttgaccctaatatcctaaccattgggactggaatggaggaacacaacttgtatgccattaattttatccatgcaacaaaagtcattaaagaaacattacctggagccagaataagtggaggtctttccaacttgtccttctccttccgaggaatggaagccattcgagaagcaatgcatggggttttcctttaccatgcaatcaagtctggcatggacatggggatagtgaatgctggaaacctccctgtgtatgatgatatccataaggaacttctgcagctctgtgaagatctcatctggaataaagaccctgaggccactgagaagctcttacgttatgcccagactcaaggcacaggagggaagaaagtcattcagactgatgagtggagaaatggccctgtcgaagaacgccttgagtatgcccttgtgaagggcattgaaaaacatattattgaggatactgaggaagccaggttaaaccaaaaaaaatatccccgacctctcaatataattgaaggacccctgatgaatggaatgaaaattgttggtgatctttttggagctggaaaaatgtttctacctcaggttataaagtcagcccgggttatgaagaaggctgttggccaccttatccctttcatggaaaaagaaagagaagaaaccagagtgcttaacggcacagtagaagaagaggacccttaccagggcaccatcgtgctggccactgttaaaggcgacgtgcacgacataggcaagaacatagttggagtagtccttggctgcaataatttccgagttattgatttaggagtcatgactccatgtgataagatactgaaagctgctcttgaccacaaagcagatataattggcctgtcaggactcatcactccttccctggatgaaatgatttttgttgccaaggaaatggagagattagctataaggattccattgttgattggaggagcaaccacttcaaaaacccacacagcagttaaaatagctccgagatacagtgcacctgtaatccatgtcctggacgcgtccaagagtgtggtggtgtgttcccagctgttagatgaaaatctaaaggatgaatactttgaggaaatcatggaagaatatgaagatattagacaggaccattatgagtctctcaaggagaggagatacttacccttaagtcaagccagaaaaagtggtttccaaatggattggctgtctgaacctcacccagtgaagcccacgtttattgggacccaggtctttgaagactatgacctgcagaagctggtggactacattgactggaagcctttctttgatgtctggcagctccggggcaagtacccgaatcgaggctttcccaagatatttaacgacaaaacagtaggtggagaggccaggaaggtctacgatgatgcccacaatatgctgaacacactgattagtcaaaagaaactccgggcccggggtgtggttgggttctggccagcacagagtatccaagacgacattcacctgtacgcggaggctgctgtgccccaggctgcagagcccatagccaccttctatgggttaaggcaacaggctgagaaggactctgccagcacggagccatactactgcctctcagacttcatcgctcccttgcattctggcatccgtgactacctgggcctgtttgccgttgcctgctttggggtagaagagctgagcaaggcctatgaggatgatggtgacgactacagcagcatcatggtcaaggcgctgggggaccggctggcagaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagacttgcagacatcgagcagtctacaggcattaggttaacagaatcattagcaatggcacctgcttcagcagtctcaggcctctacttctccaatttgaagtccaaatattttgctgtggggaagatttccaaggatcaggttgaggattatgcattgaggaagaacatatctgtggctgaggttgagaaatggcttggacccattttgggatatgatacagactaa

SEQ ID NO: 44 - protein, 1265 aa, Homo sapiens
MSPALQDLSQPEGLKKTLRDEINAILQKRIMVLDGGMGTMIQREKLNEEHFRGQEFKDHARPLKGNNDILSITQPDVIYQIHKEYLLAGADIIETNTFSSTSIAQADYGLEHLAYRMNMCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 45 - DNA, 3681 bp, Vibrio fisheri
  CDS (1)..(3678): AB039955
gtggcaggaagcaatataaaagtacaaatagaaaagcaactttcagagcgaattttattgattgatggtggtatgggcaccatgattcaaggttataagtttgaagagaaagattatagagggggacgctttaatcaatggcattgtgatcttaaaggtaacaatgatttattagttctttcacaaccacaaattataagagatatacacgaagcctatttagaagctggtgctgatatccttgaaactaatacctttaatgcaacaactattgctatggctgattatgatatggaaagccttagtgaagagattaactttgaagcagcaaagcttgctcgtgaagttgcagataaatggacagaaaaaacaccaaacaaacctcgctatgtagcaggagtgcttggaccaacaaatcgaacttgttctatttctccagacgtaaatgaccctggctttcgtaatgtatcgtttgatgaattagtcgaagcttattcagagtcaactcgagcacttattagaggtggttcagatcttatcctcatcgaaactatatttgatacattaaatgctaaagcgtgttcttttgctgttgaatctgtttttgaagagcttggtattactttgcctgttatgatttcagggaccattaccgatgcatcaggaagaacattatcggggcaaacaacagaagctttttataatgcattaagacatgtaaaacctatttcttttggtcttaactgtgcacttggtcctgatgaattacgtgaatatgtaagcgagctttcacgtatttctgaatgttatgtttctgcgcacccaaacgctggtttgcctaatgcatttggtgagtatgatttatctcccgaagatatggctgagcatgttgcggaatgggcaagcagcggatttttaaatcttattggtgggtgttgtggcaccactcctgaacatattcgtcaaatggctttagttgttgaaggtgtgaaacctcgacaattacctgaattacccgtagcttgtcgtctttccggattagagcctttaacaatagaaaaagattctttgtttattaatgttggtgaacgtacaaatgttactggatctgcacgttttaaacgcttaattaaagaagagctttatgacgaagcactaagtgttgctcaagagcaagttgaaaacggtgctcaaattatcgatatcaacatggatgaaggcatgcttgatgctgaagcatgtatggttcgttttttaaatctttgtgcatcagaacctgaaatatctaaagtaccagtgatggttgattcttctaaatgggaagtaattgaagctggattaaagtgtattcaaggtaaggggatagttaattcaatctctttaaaggaaggcaaagaaaagtttgtacatcaagccaagttaatacgtcgttatggtgctgcagtgatcgttatggcttttgatgaagttggccaagcggacactcgggagcgtaaaattgaaatttgtaccaatgcctacaatattttagttgatgaagttggcttcccacctgaagatattatttttgaccctaatatttttgcggttgctacaggtatcgatgaacataataactatgcagtagactttattgaagccgttggtgatataaagcgaacgcttcctcatgcaatgatttcaggtggtgtttctaacgtctctttttctttccgtggaaataactacgttcgtgaagctatccatgccgtatttttatatcactgttttaaaaatggtatggatatgggcatcgtaaatgcggggcagctggaaatatatgataacgtaccagaagatctgcgtgaagcggttgaagatgtggtattgaatcgtcgagatgattctacggagcgtttacttgatattgcaactgagtatttagaacgagctgttggtaaagttgaagataaatctgctttagagtggcgtgactggcctgttgaaaaacgtcttgagcattctctagtgaaggggataacagagtttattgtcgaagatacagaagaagcacgaatcaatgcagaaagaccaatagaggtaattgaagggccattgatggacggaatgaacgtcgttggtgatctttttggggaaggaaaaatgttccttccccaagtagtaaagtctgctcgtgtaatgaaacaagctgttgctcatttagaaccgtttattaatgcgtctaaagaagttggagcaacaaacggtaaaatacttttagcaacagtaaaaggtgatgttcatgatattggtaagaatatcgttggcgtggttttacagtgtaataactatgaaataattgatcttggtgtcatggtctcttgtgaaactatcttaaaagtagccaaagaagaaaatgtagacatcattggtttatctggattaataacaccatcattagatgaaatggtccatgttgctaaagagatggaacgacaagggtttgatttaccattgttgattggtggagcaacaacttcaaaagcacatacagcggtaaaaattgaacaaaactattctcaacctgttgtgtacgttaataatgcttctcgagctgtaggtgtatgtacttcattactttcaaatgaactaaaaccttcttttgttgagaagctagatattgattacgaacgtgttagagagcagcatagtcgtaaacaaccgcgaactaagcctgtgactttagaggttgctcgagcgaataaagtcgctattgactgggcttcttatacacctcctgtcccactaaagcctggtgtacatatatttgataactttgatgtttcaacattgcgtaattatattgattggaccccattttttatgacgtggtctcttgttggaaaatacccgaagatcttagagcatgaagaagttggtgaagaagccaaacgattatttaaagatgcaaatgatctattagatcgagttgaaaaagaagggttacttaaagcccgtggaatgtgtgcgctatttccagcttccagtgttggtgatgatattgaagtatatactgatgaatcacgcactacagttgcaaaagtacttcataatttgcgacaacaaacggagaagccgaaaggttttaattattgtttatctgattatatagcacccaaagagtcgggtaaaaatgattggatcggtggttttgctgtaactggtggtattggtgagcgtgaactagctgatgaatataaagcaaatggtgatgattataacgctatcatgattcaagcggtggctgatcgtctagctgaagcttttgctgaatatttacatgaaaaagtacgtaaggaaatttggggttactctcctaatgagacgctttcaaatgatgatttaatccgtgaaaaataccaaggcattcgtcctgctcctggttacccagcttgtcctgaacatacagaaaaaggggctttatgggagttaatgaatgttgaagaatctattggaatgtctttaacatcaagctatgcaatgtggcccggtgcatctgtgtcaggaatgtatttttcacacccagattctcgttattttgcgattgctcagattcagcaagatcaagccgaaagctatgccgatcgtaaaggttggaatatgcttgaagctgagaagtggttaggtccaaatttgaattaa

SEQ ID NO: 46 - protein, 1226 aa, Vibrio fisheri
VAGSNIKVQIEKQLSERILLIDGGMGTMIQGYKFEEKDYRGGRFNQWHCDLKGNNDLLVLSQPQIIRDIHEAYLEAGADILETNTFNATTIAMADYDMESLSEEINFEAAKLAREVADKWTEKTPNKPRYVAGVLGPTNRTCSISPDVNDPGFRNVSFDELVEAYSESTRALIRGGSDLILIETIFDTLNAKACSFAVESVFEELGITLPVMISGTITDASGRTLSGQTTEAFYNALRHVKPISFGLNCALGPDELREYVSELSRISECYVSAHPNAGLPNAFGEYDLSPEDMAEHVAEWASSGFLNLIGGCCGTTPEHIRQMALVVEGVKPRQLPELPVACRLSGLEPLTIEKDSLFINVGERTNVTGSARFKRLIKEELYDEALSVAQEQVENGAQIIDINMDEGMLDAEACMVRFLNLCASEPEISKVPVMVDSSKWEVIEAGLKCIQGKGIVNSISLKEGKEKFVHQAKLIRRYGAAVIVMAFDEVGQADTRERKIEICTNAYNILVDEVGFPPEDIIFDPNIFAVATGIDEHNNYAVDFIEAVGDIKRTLPHAMISGGVSNVSFSFRGNNYVREAIHAVFLYHCFKNGMDMGIVNAGQLEIYDNVPEDLREAVEDVVLNRRDDSTERLLDIATEYLERAVGKVEDKSALEWRDWPVEKRLEHSLVKGITEFIVEDTEEARINAERPIEVIEGPLMDGMNVVGDLFGEGKMFLPQVVKSARVMKQAVAHLEPFINASKEVGATNGKILLATVKGDVHDIGKNIVGVVLQCNNYEIIDLGVMVSCETILKVAKEENVDIIGLSGLITPSLDEMVHVAKEMERQGFDLPLLIGGATTSKAHTAVKIEQNYSQPVVYVNNASRAVGVCTSLLSNELKPSFVEKLDIDYERVREQHSRKQPRTKPVTLEVARANKVAIDWASYTPPVPLKPGVHIFDNFDVSTLRNYIDWTPFFMTWSLVGKYPKILEHEEVGEEAKRLFKDANDLLDRVEKEGLLKARGMCALFPASSVGDDIEVYTDESRTTVAKVLHNLRQQTEKPKGFNYCLSDYIAPKESGKNDWIGGFAVTGGIGERELADEYKANGDDYNAIMIQAVADRLAEAFAEYLHEKVRKEIWGYSPNETLSNDDLIREKYQGIRPAPGYPACPEHTEKGALWELMNVEESIGMSLTSSYAMWPGASVSGMYFSHPDSRYFAIAQIQQDQAESYADRKGWNMLEAEKWLGPNLN

SEQ ID NO: 47 - DNA, 3780 bp, Agrobacterium tumefaciens
  CDS (1)..(3777): 15887359
gtgcccgtgtttgacgacctgtttggccctgaaggggcaaagcgcgacggcgcggaaattttcaaggcgttgcgcgatgccgccagcgaacgcatcctcattctcgatggtgccatgggcacgcagatccagggtctcggttttgacgaggatcattttcgtggcgaccgttttatcggctgcgcctgtcaccagaagggcaataacgaccttctgatcctgacacagcccgatgccatcgaggaaatccactatcgctacgccatggcgggcgcggatattctcgaaaccaacacgttttcctccacccgcatcgcgcaggccgattacgagatggagaatgccgtctacgatctcaaccgcgagggcgcggcgatcgtgcgccgggcggctcagcgcgccgagcgcgaggatggccgccgccgtttcgtggccggtgccatcggtccgaccaaccgcacggcctcgatctcgcctgacgtcaacaatcccggttaccgcgccgtcagtttcgacgatctgcgcattgcctatggcgagcagatcgatggcctgatcgacggtggtgccgatatcatcctcatcgagacgatcttcgatacgctgaacgccaaggcggcgatcttcgcctgcgaggaacgtttcgaggctaagggcatccgcctgccggtcatgatctcaggcacgatcaccgacctttccggtcgcacgttgtccggccagacgccttcggcgttctggaactcggtgcgccacgccaaccccttcaccatcggcctcaactgcgcgctcggtgcggatgccatgcgcccgcatctgcaggaactgtccgatgtggccgacacctttgtctgcgcctatccgaatgccggcctgccgaacgagttcggccaatatgacgaaacgcccgagatgatggcgcgccaggttgagggcttcgttcgtgacggtctcgtcaacatcgtcggcggttgctgcggttcgacgccggaacatatccgggcgattgccgaagccgtcaaggattacaagccccgcgaaattcctgaacacaagccgttcatgtcgctttccggccttgaacccttcgtgctgaccaaggacattcccttcgtcaacgtgggcgagcgcaccaacgtcaccggttcggcccgcttccgcaagctcatcactgccggcgactatacggcggcgctggctgttgcccgcgaccaggtggaaaacggcgcgcagatcatcgacatcaacatggatgagggcctgatcgattcggaaaaggcgatggtcgagttcctgaacctcatcgccgccgagcctgacattgcccgtgtgcccgtcatgatcgactcatccaagttcgagatcatcgaggccggcctgaaatgcgtgcagggcaaatcgatcgtcaattccatttcgctgaaggaaggcgaggagaagtttctccagcaggctcggctcgtccacaattacggtgcggcggttgtcgtcatggcctttgatgaggtcgggcaggcggatacctatcagcgcaaggtggaaatctgcgcgcgcgcctacaagcttctgaccgaaaaggccggtctgtctccggaagacatcatcttcgacccgaatgtgtttgcggtagctacgggcatcgaggagcacaataattacggcgtggacttcatcgaggccaccaagaccatccgcgaaaccatgccgctcacgcatatttccgggggcgtttccaacctgtccttctccttccgcggcaatgagccggtgcgtgaggcgatgcatgccgtgttcctctatcacgccattcaggtcggcatggatatgggcatcgtcaacgccgggcagcttgcggtttacgacaatatcgatgcggaactgcgcgaggcctgcgaagacgtggtgctgaaccgccgcgacgatgccacggagcgtctgctcgaggtggcggagcgtttccgtggtacgggtgaaaaacaggccaaggtgcaggatctttcctggcgcgagtatcccgttgaaaagcggctggaacatgctctggtcaacggcattaccgactatatcgaggccgatacggaagaggcacgccagcaggccgcccgcccgctgcatgtcatcgaagggccgctgatggccggtatgaatgtggtgggtgacctgttcggttccggcaagatgttcctgccacaggtggtgaaatccgcccgtgtgatgaagcaggcggttgccgttctgctgccttacatggaagaggaaaagcgcctgaatggcggttccgagcgcagtgccgccggcaaggtgctaatggcgaccgtgaagggcgacgtgcacgatatcggcaagaacatcgtcggcgttgtgctagcctgcaacaattacgagatcattgatctcggcgtgatggtgccgacgacgaaaatcctcgaaacggcgatcgccgaaaaggtggatgtgatcggcctctccggcctcatcaccccgtcgctggatgagatggtgcatgtggcggccgaaatggagcgacagggtttcgacattccgctgctgatcggcggtgcgacgaccagccgtgtgcatacggcggtaaaaatccatccgcgttacgagcaggggcaggcgatctatgtcaccgacgcctcgcgcgcggtgggcgtcgtttcagcgctcctctccgaagagcagaagcccgcttatatcgacggcatccgagccgaatatgccaaggtggcggaagcccatgcccgcaatgagcgcgaaaagcagcgcctgccgctttcccgcgcccgggagaatgcgcacaagatcgactggtcgagctacagcgttgtcaagccgcagttcttcggcaccaaggtttttgagacctatgatctggaagagctttcccgttacatcgactggacgccgttcttccagacctgggaattgaagggccgtttcccggcgatccttgaagacgaaaagcagggcgaggcggcgcggcagctttatgccgatgcgcaggccatgcttgcgaagatcatcgaggaaaagtggttccgaccacgcgcggtgatcggcttctggccggccaatgccgtgggtgacgatatcaggctctttacggatgaaggtcggaaggaagagttggcgacgttcttcacgctgcgccagcagctttccaagcgcgatggccgtccgaacgtggcgctgtccgatttcgtcgcgcccgtcgatagcggcgttgccgattatgtcggcggtttcgtggtaacggcgggtatcgaggaagtggcgattgccgagcgcttcgagcgggccaatgacgattattcgtccatcctcgtcaaggcgttggctgaccgttttgccgaagcctttgccgagcgtatgcatgagcgcgtgcgcaaggagttctggggttatgcgccggacgaggctcttgccggtgacgatctgataggcgaagcctatgccggtatccgcccggcaccgggttatccggcccagccggaccacaccgaaaagaagacgctgtttgctctgctggacgccaccaatgcggcgggtgtggaattgacggaaagctatgcgatgtggcccggctcgtcggtttcgggcctctatatcggccatcccgaaagctattatttcggcgttgccaaggtggagcgggatcaggttctcgactatgcgcgccgcaaggatatgccggtcacagaggtggagcgctggctcgggccggtgctcaactacgtgccgaccaacggcgaggagaaaatcgacagcgctgcgtga

SEQ ID NO: 48 - protein, 1259 aa, Agrobacterium tumefaciens
VPVFDDLFGPEGAKRDGAEIFKALRDAASERILILDGAMGTQIQGLGFDEDHFRGDRFIGCACHQKGNNDLLILTQPDAIEEIHYRYAMAGADILETNTFSSTRIAQADYEMENAVYDLNREGAAIVRRAAQRAEREDGRRRFVAGAIGPTNRTASISPDVNNPGYRAVSFDDLRIAYGEQIDGLIDGGADIILIETIFDTLNAKAAIFACEERFEAKGIRLPVMISGTITDLSGRTLSGQTPSAFWNSVRHANPFTIGLNCALGADAMRPHLQELSDVADTFVCAYPNAGLPNEFGQYDETPEMMARQVEGFVRDGLVNIVGGCCGSTPEHIRAIAEAVKDYKPREIPEHKPFMSLSGLEPFVLTKDIPFVNVGERTNVTGSARFRKLITAGDYTAALAVARDQVENGAQIIDINMDEGLIDSEKAMVEFLNLIAAEPDIARVPVMIDSSKFEIIEAGLKCVQGKSIVNSISLKEGEEKFLQQARLVHNYGAAVVVMAFDEVGQADTYQRKVEICARAYKLLTEKAGLSPEDIIFDPNVFAVATGIEEHNNYGVDFIEATKTIRETMPLTHISGGVSNLSFSFRGNEPVREAMHAVFLYHAIQVGMDMGIVNAGQLAVYDNIDAELREACEDVVLNRRDDATERLLEVAERFRGTGEKQAKVQDLSWREYPVEKRLEHALVNGITDYIEADTEEARQQAARPLHVIEGPLMAGMNVVGDLFGSGKMFLPQVVKSARVMKQAVAVLLPYMEEEKRLNGGSERSAAGKVLMATVKGDVHDIGKNIVGVVLACNNYEIIDLGVMVPTTKILETAIAEKVDVIGLSGLITPSLDEMVHVAAEMERQGFDIPLLIGGATTSRVHTAVKIHPRYEQGQAIYVTDASRAVGVVSALLSEEQKPAYIDGIRAEYAKVAEAHARNEREKQRLPLSRARENAHKIDWSSYSVVKPQFFGTKVFETYDLEELSRYIDWTPFFQTWELKGRFPAILEDEKQGEAARQLYADAQAMLAKIIEEKWFRPRAVIGFWPANAVGDDIRLFTDEGRKEELATFFTLRQQLSKRDGRPNVALSDFVAPVDSGVADYVGGFVVTAGIEEVAIAERFERANDDYSSILVKALADRFAEAFAERMHERVRKEFWGYAPDEALAGDDLIGEAYAGIRPAPGYPAQPDHTEKKTLFALLDATNAAGVELTESYAMWPGSSVSGLYIGHPESYYFGVAKVERDQVLDYARRKDMPVTEVERWLGPVLNYVPTNGEEKIDSAA

SEQ ID NO: 49 - DNA, 2718 bp, Ralstonia solanacearum
  CDS (1)..(2715): RSOL_GMI1000
atgaccgaccacctcatgcgcctctccggcctcgaaccgttcaacatcggcgaggacacgctgttcgtcaacgtcggcgaacgcaccaacgtcaccggatccaaggcgttcgcgcgcatgatcctcaacagccagttcgacgaggcgctcgccgtggcacgccagcaggtcgagaacggcgcgcaggtcatcgacatcaacatggacgaggccatgctcgactccaaggcggcgatggtgcgcttcctgaacctgatcgcctcggagccggacatcgcgcgcgtgccgatcatgatcgactcgtccaagtgggaggtgatcgaggccggcctgaagtgcgtgcagggcaaggccatcgtcaactcgatctcgctcaaggaaggcgaggaacagttcgcccaccacgccaagctgatcaagcgctacggcgccgccgccgtggtgatggccttcgacgagcagggccaggccgacacgttcgcgcgcaagaccgagatctgcaagcgcagctatgacttcctcgtgaaccaggtcggctttgcgccggaagacatcatcttcgatccgaacatcttcgcggtcgccaccggcatcgaggagcacaacaactacgccgtcgacttcatcgaggccacgcgctggatcaagcagaaattgccgcacgccaaggtgagcggcggcgtgtcgaacgtctcgttctcgttccgcggcaacgacgtggtgcgcgaggccatccacaccgtgttcctgtaccacgccatcggtgcgggcatggacatgggcatcgtcaacgcgggccagttgggcgtgtacgagaacctcgcccccgaactgcgcgagcgcgtggaagacgtggtgctcaaccgccgcccggatgcgaccgaccgcctgctggaaattgccgaccgctacaagggcggcggcgccaagcgcgaggagaacctcgcctggcgccaggagccggtggaaaagcgcctggcccacgcgctcgtgcacggcatcaccgactacgtggtcgaagacaccgaggaagttcgccagaagatctttgccgccggcggccgcccgatccaggtgatcgagggcccgctgatggacggcatgaacatcgtcggcgatctgttcggcgcgggcaagatgttcctgccgcaggtggtgaaatccgcccgcgtgatgaagcaggcggtggcccacctgatcccgttcatcgaggaagagaagcggcagatcgcggccgccggcggcgacgtgcgctcgcgcggcaagatcgtcatcgccaccgtgaagggcgacgtgcacgacatcggcaagaacatcgtcaccgtcgtgctccagtgcaacaacttcgaagtcgtgaacatgggcgtgatggtcccgtgcaacgagatcctggccaaggcgaaggtcgagggcgcggacatcatcggcctgtcgggcctgatcacaccgtcgctggaagagatggcctacgtggcctccgagatgcagcgcgacgagtacttccgcgtgaagaagatcccgctgctgatcggtggcgcgaccacgagccgcgtgcacaccgccgtgaagatcgcgcccaattacgaaggcccggtcgtgtacgtgcccgacgcctcgcgctcggtgagcgtggcctccagcctgctgtccgacgaggccgccgcgcgctacatcgaagagctgcacgccgactacgaccgcatccgcacccagcacgccagcaagaaagccatgccgatggtgtcgctggccgccgcgcgcgccaacaagacccggatcgactggtcgaactacacgccgcccaagcccaagttcgtcggccgccgcgtgttccgcaactacgacctgaacgagctcgcgcagtacatcgactggggcccgttcttccagacgtgggacctggccggcaaattccccgacatcctcaacgacgcgatcgtcggcgaatcggcccgccgcgtgttctccgacggcaagagcatgctcgcgcgcctgatcgccggacgctggctgacggccaacggcgtgatcgcgctgctgccggccaacaccgtcaacgacgacgacatcgagatctacaccgacgagacccgctcggaagtcgccctcacctggcgcaacatccgccagcagagcgagcgcccgatcatcgacggcgtgatgcgcccgaaccgctgcctggcggacttcatcgcccccaaggacaccggcatcgccgattacatcggcctcttcgcggtgacgggcggcatcgggatcgacaagcgcgaagccgccttcgaagccgaccacgacgactacagcgcgatcatgctcaaggccctggccgaccgcttcgccgaagccttcgccgagtgcctgcacgcccgtgtgcgccgcgacctgtggggctacgcgcaggacgaaacgctcgacaacgacgcgctgatccgcgaggaataccgcggcatccgcccggcgcccggctacccggcctgcccggagcacaccgtcaagcgcgacctgttccgcgtgctcgacgcgcaggagatcggcatgaacctgaccgaggcgctggcgatgacaccggccgcgtcggtctcgggcttccagctgtcgcacccggacagcacgtacttcacgatcggcaagatcggccaggaccaggtggacgacatggccgcgcgcagcggggaagaccgccgcaatgtggagcgcgccctggcacccaacctgtaa

SEQ ID NO: 50 - protein, 905 aa, Ralstonia solanacearum
MTDHLMRLSGLEPFNIGEDTLFVNVGERTNVTGSKAFARMILNSQFDEALAVARQQVENGAQVIDINMDEAMLDSKAAMVRFLNLIASEPDIARVPIMIDSSKWEVIEAGLKCVQGKAIVNSISLKEGEEQFAHHAKLIKRYGAAAVVMAFDEQGQADTFARKTEICKRSYDFLVNQVGFAPEDIIFDPNIFAVATGIEEHNNYAVDFIEATRWIKQKLPHAKVSGGVSNVSFSFRGNDVVREAIHTVFLYHAIGAGMDMGIVNAGQLGVYENLAPELRERVEDVVLNRRPDATDRLLEIADRYKGGGAKREENLAWRQEPVEKRLAHALVHGITDYVVEDTEEVRQKIFAAGGRPIQVIEGPLMDGMNIVGDLFGAGKMFLPQVVKSARVMKQAVAHLIPFIEEEKRQIAAAGGDVRSRGKIVIATVKGDVHDIGKNIVTVVLQCNNFEVVNMGVMVPCNEILAKAKVEGADIIGLSGLITPSLEEMAYVASEMQRDEYFRVKKIPLLIGGATTSRVHTAVKIAPNYEGPVVYVPDASRSVSVASSLLSDEAAARYIEELHADYDRIRTQHASKKAMPMVSLAAARANKTRIDWSNYTPPKPKFVGRRVFRNYDLNELAQYIDWGPFFQTWDLAGKFPDILNDAIVGESARRVFSDGKSMLARLIAGRWLTANGVIALLPANTVNDDDIEIYTDETRSEVALTWRNIRQQSERPIIDGVMRPNRCLADFIAPKDTGIADYIGLFAVTGGIGIDKREAAFEADHDDYSAIMLKALADRFAEAFAECLHARVRRDLWGYAQDETLDNDALIREEYRGIRPAPGYPACPEHTVKRDLFRVLDAQEIGMNLTEALAMTPAASVSGFQLSHPDSTYFTIGKIGQDQVDDMAARSGEDRRNVERALAPNL

SEQ ID NO: 51 - DNA, 3645 bp, Chlorobium tepidum; identical to SEQ ID NO: 33
  CDS (1)..(3642): RCL00420

SEQ ID NO: 52 - protein, 1214 aa, Chlorobium tepidum; identical to SEQ ID NO: 34
  unsure 936 .. 936: All occurrences of Xaa indicate any amino acid

SEQ ID NO: 53 - DNA, 52 bp, Artificial Sequence
  PCR primer
cccgggatccgctagcggcgcgccggccggcccggtgtgaaataccgcacag

SEQ ID NO: 54 - DNA, 53 bp, Artificial Sequence
  PCR primer
tctagactcgagcggccgcggccggcctttaaattgaagacgaaagggcctcg

SEQ ID NO: 55 - DNA, 47 bp, Artificial Sequence
  PCR primer
gagatctagacccggggatccgctagcgggctgctaaaggaagcgga

SEQ ID NO: 56 - DNA, 38 bp, Artificial Sequence
  PCR primer
gagaggcgcgccgctagcgtgggcgaagaactccagca

SEQ ID NO: 57 - DNA, 34 bp, Artificial Sequence
  PCR primer
gagagggcggccgcgcaaagtcccgcttcgtgaa

SEQ ID NO: 58 - DNA, 34 bp, Artificial Sequence
  PCR primer
gagagggcggccgctcaagtcggtcaagccacgc

SEQ ID NO: 59 - DNA, 140 bp, Artificial Sequence
  PCR primer
tcgaatttaaatctcgagaggcctgacgtcgggcccggtaccacgcgtcatatgactagttcggacctagggatatcgtcgacatcgatgctcttctgcgttaattaacaattgggatcctctagacccgggatttaaat

SEQ ID NO: 60 - DNA, 140 bp, Artificial Sequence
  PCR primer
gatcatttaaatcccgggtctagaggatcccaattgttaattaacgcagaagagcatcgatgtcgacgatatccctaggtccgaactagtcatatgacgcgtggtaccgggcccgacgtcaggcctctcgagatttaaat

SEQ ID NO: 61 - DNA, 33 bp, Artificial Sequence
  PCR primer
gagagcggccgccgatcctttttaacccatcac

SEQ ID NO: 62 - DNA, 32 bp, Artificial Sequence
  PCR primer
aggagcggccgccatcggcattttcttttgcg

SEQ ID NO: 63 - DNA, 5091 bp, Artificial Sequence
  Plasmid
gccgcgactgccttcgcgaagccttgccccgcggaaatttcctccaccgagttcgtgcacacccctatgccaagcttctttcaccctaaattcgagagattggattcttaccgtggaaattcttcgcaaaaatcgtcccctgatcgcccttgcgacgttggcgtcggtgccgctggttgcgcttggcttgaccgacttgatcagcggccgctcgatttaaatctcgagaggcctgacgtcgggcccggtaccacgcgtcatatgactagttcggacctagggatatcgtcgacatcgatgctcttctgcgttaattaacaattgggatcctctagacccgggatttaaatcgctagcgggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgctagcggcgcgccggccggcccggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaaggccggccgcggccgcgcaaagtcccgcttcgtgaaaattttcgtgccgcgtgattttccgccaaaaactttaacgaacgttcgttataatggtgtcatgaccttcacgacgaagtactaaaattggcccgaatcatcagctatggatctctctgatgtcgcgctggagtccgacgcgctcgatgctgccgtcgatttaaaaacggtgatcggatttttccgagctctcgatacgacggacgcgccagcatcacgagactgggccagtgccgcgagcgacctagaaactctcgtggcggatcttgaggagctggctgacgagctgcgtgctcggccagcgccaggaggacgcacagtagtggaggatgcaatcagttgcgcctactgcggtggcctgattcctccccggcctgacccgcgaggacggcgcgcaaaatattgctcagatgcgtgtcgtgccgcagccagccgcgagcgcgccaacaaacgccacgccgaggagctggaggcggctaggtcgcaaatggcgctggaagtgcgtcccccgagcgaaattttggccatggtcgtcacagagctggaagcggcagcgagaattatcgcgatcgtggcggtgcccgcaggcatgacaaacatcgtaaatgccgcgtttcgtgtgccgtggccgcccaggacgtgtcagcgccgccaccacctgcaccgaatcggcagcagcgtcgcgcgtcgaaaaagcgcacaggcggcaagaagcgataagctgcacgaatacctgaaaaatgttgaacgccccgtgagcggtaactcacagggcgtcggctaacccccagtccaaacctgggagaaagcgctcaaaaatgactctagcggattcacgagacattgacacaccggcctggaaattttccgctgatctgttcgacacccatcccgagctcgcgctgcgatcacgtggctggacgagcgaagaccgccgcgaattcctcgctcacctgggcagagaaaatttccagggcagcaagacccgcgacttcgccagcgcttggatcaaagacccggacacggagaaacacagccgaagttataccgagttggttcaaaatcgcttgcccggtgccagtatgttgctctgacgcacgcgcagcacgcagccgtgcttgtcctggacattgatgtgccgagccaccaggccggcgggaaaatcgagcacgtaaaccccgaggtctacgcgattttggagcgctgggcacgcctggaaaaagcgccagcttggatcggcgtgaatccactgagcgggaaatgccagctcatctggctcattgatccggtgtatgccgcagcaggcatgagcagcccgaatatgcgcctgctggctgcaacgaccgaggaaatgacccgcgttttcggcgctgaccaggctttttcacataggctgagccgtggccactgcactctccgacgatcccagccgtaccgctggcatgcccagcacaatcgcgtggatcgcctagctgatcttatggaggttgctcgcatgatctcaggcacagaaaaacctaaaaaacgctatgagcaggagttttctagcggacgggcacgtatcgaagcggcaagaaaagccactgcggaagcaaaagcacttgccacgcttgaagcaagcctgccgagcgccgctgaagcgtctggagagctgatcgacggcgtccgtgtcctctggactgctccagggcgtgccgcccgtgatgagacggcttttcgccacgctttgactgtgggataccagttaaaagcggctggtgagcgcctaaaagacaccaagggtcatcgagcctacgagcgtgcctacaccgtcgctcaggcggtcggaggaggccgtgagcctgatctgccgccggactgtgaccgccagacggattggccgcgacgtgtgcgcggctacgtcgctaaaggccagccagtcgtccctgctcgtcagacagagacgcagagccagccgaggcgaaaagctctggccactatgggaagacgtggcggtaaaaaggccgcagaacgctggaaagacccaaacagtgagtacgcccgagcacagcgagaaaaactagctaagtccagtcaacgacaagctaggaaagctaaaggaaatcgcttgaccattgcaggttggtttatgactgttgagggagagactggctcgtggccgacaatcaatgaagctatgtctgaatttagcgtgtcacgtcagaccgtgaatagagcacttaaggtctgcgggcattgaacttccacgaggacgccgaaagcttcccagtaaatgtgccatctcgtaggcagaaaacggttcccccgtagggtctctctcttggcctcctttctaggtcgggctgattgctcttgaagctctctaggggggctcacaccataggcagataacgttccccaccggctcgcctcgtaagcgcacaaggactgctcccaaagatcttcaaagccact

SEQ ID NO: 64 - DNA, 4323 bp, Artificial Sequence
  Plasmid
tctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacgtccaggccttttgcagaagagatatttttaattgtggacgaatcaaattcagaaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaaaggatcggcggccgctcgatttaaatctcgagaggcctgacgtcgggcccggtaccacgcgtcatatgactagttcggacctagggatatcgtcgacatcgatgctcttctgcgttaattaacaattgggatcctctagacccgggatttaaatcgctagcgggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgctagcggcgcgccggccggcccggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaaggccggccgcggccgccatcggcattttcttttgcgtttttatttgttaactgttaattgtccttgttcaaggatgctgtctttgacaacagatgttttcttgcctttgatgttcagcaggaagctcggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgagga

SEQ ID NO: 65 - DNA, 35 bp, Artificial Sequence
  PCR Primer
gagagagagacgcgtcccagtggctgagacgcatc

SEQ ID NO: 66 - DNA, 34 bp, Artificial Sequence
  PCR Primer
ctctctctgtcgacgaattcaatcttacggcctg

SEQ ID NO: 67 - DNA, 38 bp, Artificial Sequence
  PCR Primer
cggcaccaccgacatcatcttcacctgccctcgttccg

SEQ ID NO: 68 - DNA, 38 bp, Artificial Sequence
  PCR Primer
cggaacgagggcaggtgaagatgatgtcggtggtgccg

SEQ ID NO: 69 - DNA, 31 bp, Artificial Sequence
  PCR Primer
gagactcgagggaaggtgaatcgaatttcgg

SEQ ID NO: 70 - DNA, 38 bp, Artificial Sequence
  PCR Primer
gtcccggggagaacgcacgattctccaaaaataatcgc

SEQ ID NO: 71 - DNA, 23 bp, Artificial Sequence
  PCR Primer
gaatcgtgcgttctccccgggac

SEQ ID NO: 72 - DNA, 22 bp, Artificial Sequence
  PCR Primer
gtagttgaccgagttgatcacc

SEQ ID NO: 73 - DNA, 18 bp, Artificial Sequence
  PCR Primer
ccggcctggagaagctcg

SEQ ID NO: 74 - DNA, 28 bp, Artificial Sequence
  PCR Primer
gagagatatccctcagcgggcgttgaag

SEQ ID NO: 75 - DNA, 1266 bp, LysC Mutante
  CDS (1)..(1266)
gtggccctggtcgtacagaaatatggcggttcctcgcttgagagtgcggaacgcattagaaacgtcgctgaacggatcgttgccaccaagaaggctggaaatgatgtcgtggttgtctgctccgcaatgggagacaccacggatgaacttctagaacttgcagcggcagtgaatcccgttccgccagctcgtgaaatggatatgctcctgactgctggtgagcgtatttctaacgctctcgtcgccatggctattgagtcccttggcgcagaagcccaatctttcacgggctctcaggctggtgtgctcaccaccgagcgccacggaaacgcacgcattgttgatgtcactccaggtcgtgtgcgtgaagcactcgatgagggcaagatctgcattgttgctggtttccagggtgttaataaagaaacccgcgatgtcaccacgttgggtcgtggtggttctgacaccactgcagttgcgttggcagctgctttgaacgctgatgtgtgtgagatttactcggacgttgacggtgtgtataccgctgacccgcgcatcgttcctaatgcacagaagctggaaaagctcagcttcgaagaaatgctggaacttgctgctgttggctccaagattttggtgctgcgcagtgttgaatacgctcgtgcattcaatgtgccacttcgcgtacgctcgtcttatagtaatgatcccggcactttgattgccggctctatggaggatattcctgtggaagaagcagtccttaccggtgtcgcaaccgacaagtccgaagccaaagtaaccgttctgggtatttccgataagccaggcgaggctgcgaaggttttccgtgcgttggctgatgcagaaatcaacattgacatggttctgcagaacgtctcttctgtagaagacggcaccaccgacatcatcttcacctgccctcgttccgacggccgccgcgcgatggagatcttgaagaagcttcaggttcagggcaactggaccaatgtgctttacgacgaccaggtcggcaaagtctccctcgtgggtgctggcatgaagtctcacccaggtgttaccgcagagttcatggaagctctgcgcgatgtcaacgtgaacatcgaattgatttccacctctgagattcgtatttccgtgctgatccgtgaagatgatctggatgctgctgcacgtgcattgcatgagcagttccagctgggcggcgaagacgaagccgtcgtttatgcaggcaccggacgctaa

SEQ ID NO: 76 - protein, 421 aa, LysC Mutante
VALVVQKYGGSSLESAERIRNVAERIVATKKAGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRALADAEINIDMVLQNVSSVEDGTTDIIFTCPRSDGRRAMEILKKLQVQGNWTNVLYDDQVGKVSLVGAGMKSHPGVTAEFMEALRDVNVNIELISTSEIRISVLIREDDLDAAARALHEQFQLGGEDEAVVYAGTGR

SEQ ID NO: 77 - DNA, 5860 bp, Plasmid
cccggtaccacgcgtcccagtggctgagacgcatccgctaaagccccaggaaccctgtgcagaaagaaaacactcctctggctaggtagacacagtttataaaggtagagttgagcgggtaactgtcagcacgtagatcgaaaggtgcacaaaggtggccctggtcgtacagaaatatggcggttcctcgcttgagagtgcggaacgcattagaaacgtcgctgaacggatcgttgccaccaagaaggctggaaatgatgtcgtggttgtctgctccgcaatgggagacaccacggatgaacttctagaacttgcagcggcagtgaatcccgttccgccagctcgtgaaatggatatgctcctgactgctggtgagcgtatttctaacgctctcgtcgccatggctattgagtcccttggcgcagaagcccaatctttcacgggctctcaggctggtgtgctcaccaccgagcgccacggaaacgcacgcattgttgatgtcactccaggtcgtgtgcgtgaagcactcgatgagggcaagatctgcattgttgctggtttccagggtgttaataaagaaacccgcgatgtcaccacgttgggtcgtggtggttctgacaccactgcagttgcgttggcagctgctttgaacgctgatgtgtgtgagatttactcggacgttgacggtgtgtataccgctgacccgcgcatcgttcctaatgcacagaagctggaaaagctcagcttcgaagaaatgctggaacttgctgctgttggctccaagattttggtgctgcgcagtgttgaatacgctcgtgcattcaatgtgccacttcgcgtacgctcgtcttatagtaatgatcccggcactttgattgccggctctatggaggatattcctgtggaagaagcagtccttaccggtgtcgcaaccgacaagtccgaagccaaagtaaccgttctgggtatttccgataagccaggcgaggctgcgaaggttttccgtgcgttggctgatgcagaaatcaacattgacatggttctgcagaacgtctcttctgtagaagacggcaccaccgacatcaccttcacctgccctcgttccgacggccgccgcgcgatggagatcttgaagaagcttcaggttcagggcaactggaccaatgtgctttacgacgaccaggtcggcaaagtctccctcgtgggtgctggcatgaagtctcacccaggtgttaccgcagagttcatggaagctctgcgcgatgtcaacgtgaacatcgaattgatttccacctctgagattcgtatttccgtgctgatccgtgaagatgatctggatgctgctgcacgtgcattgcatgagcagttccagctgggcggcgaagacgaagccgtcgtttatgcaggcaccggacgctaaagttttaaaggagtagttttacaatgaccaccatcgcagttgttggtgcaaccggccaggtcggccaggttatgcgcacccttttggaagagcgcaatttcccagctgacactgttcgtttctttgcttccccacgttccgcaggccgtaagattgaattcgtcgacatcgatgctcttctgcgttaattaacaattgggatcctctagacccgggatttaaatcgctagcgggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgctagcggcgcgccggccggcccggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaaggccggccgcggccgccatcggcattttcttttgcgtttttatttgttaactgttaattgtccttgttcaaggatgctgtctttgacaacagatgttttcttgcctttgatgttcagcaggaagctcggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgaggatctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacgtccaggccttttgcagaagagatatttttaattgtggacgaatcaaattcagaaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaaaggatcggcggccgctcgatttaaatctcgagaggcctgacgtcggg

SEQ ID NO: 78 - DNA, 5860 bp, Plasmid
cccggtaccacgcgtcccagtggctgagacgcatccgctaaagccccaggaaccctgtgcagaaagaaaacactcctctggctaggtagacacagtttataaaggtagagttgagcgggtaactgtcagcacgtagatcgaaaggtgcacaaaggtggccctggtcgtacagaaatatggcggttcctcgcttgagagtgcggaacgcattagaaacgtcgctgaacggatcgttgccaccaagaaggctggaaatgatgtcgtggttgtctgctccgcaatgggagacaccacggatgaacttctagaacttgcagcggcagtgaatcccgttccgccagctcgtgaaatggatatgctcctgactgctggtgagcgtatttctaacgctctcgtcgccatggctattgagtcccttggcgcagaagcccaatctttcacgggctctcaggctggtgtgctcaccaccgagcgccacggaaacgcacgcattgttgatgtcactccaggtcgtgtgcgtgaagcactcgatgagggcaagatctgcattgttgctggtttccagggtgttaataaagaaacccgcgatgtcaccacgttgggtcgtggtggttctgacaccactgcagttgcgttggcagctgctttgaacgctgatgtgtgtgagatttactcggacgttgacggtgtgtataccgctgacccgcgcatcgttcctaatgcacagaagctggaaaagctcagcttcgaagaaatgctggaacttgctgctgttggctccaagattttggtgctgcgcagtgttgaatacgctcgtgcattcaatgtgccacttcgcgtacgctcgtcttatagtaatgatcccggcactttgattgccggctctatggaggatattcctgtggaagaagcagtccttaccggtgtcgcaaccgacaagtccgaagccaaagtaaccgttctgggtatttccgataagccaggcgaggctgcgaaggttttccgtgcgttggctgatgcagaaatcaacattgacatggttctgcagaacgtctcttctgtagaagacggcaccaccgacatcatcttcacctgccctcgttccgacggccgccgcgcgatggagatcttgaagaagcttcaggttcagggcaactggaccaatgtgctttacgacgaccaggtcggcaaagtctccctcgtgggtgctggcatgaagtctcacccaggtgttaccgcagagttcatggaagctctgcgcgatgtcaacgtgaacatcgaattgatttccacctctgagattcgtatttccgtgctgatccgtgaagatgatctggatgctgctgcacgtgcattgcatgagcagttccagctgggcggcgaagacgaagccgtcgtttatgcaggcaccggacgctaaagttttaaaggagtagttttacaatgaccaccatcgcagttgttggtgcaaccggccaggtcggccaggttatgcgcacccttttggaagagcgcaatttcccagctgacactgttcgtttctttgcttccccacgttccgcaggccgtaagattgaattcgtcgacatcgatgctcttctgcgttaattaacaattgggatcctctagacccgggatttaaatcgctagcgggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgctagcggcgcgccggccggcccggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaaggccggccgcggccgccatcggcattttcttttgcgtttttatttgttaactgttaattgtccttgttcaaggatgctgtctttgacaacagatgttttcttgcctttgatgttcagcaggaagctcggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgaggatctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacgtccaggccttttgcagaagagatatttttaattgtggacgaatcaaattcagaaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaaaggatcggcggccgctcgatttaaatctcgagaggcctgacgtcggg

SEQ ID NO: 79 - DNA, 8787 bp, Plasmid
tcgagggaaggtgaatcgaatttcggggctttaaagcaaaaatgaacagcttggtctatagtggctaggtaccctttttgttttggacacatgtagggtggccgaaacaaagtaataggacaacaacgctcgaccgcgattatttttggagaatcgtgcgttctccccgggacgtcccacgacgggcggcaccgggcagaggcaaagccgacagccgtcgcatcctagggagccctttcatggcctcgtcgccatccaccccgcccgccgacacccgcacccgcgtgtccgccctccgagaggccctcgccacccgcgtggtggtcgccgacggcgccatgggcaccatgctccaggcccagaaccccacgctggacgacttccagcagctcgaagggtgcaacgaggtcctgaacctcacccggcccgacatcgtccgctcggtgcacgaggagtacttcgcggccggcgtcgactgcgtcgagaccaacaccttcggcgccaaccactccgccctgggcgagtacgacatccccgagcgcgtccacgaactgtccgaggccggcgcccgcgtcgcccgcgaggtcgccgacgagttcggcgcccgcgacggccggcagcgctgggtgctgggctccatgggccccggcaccaagctccccaccctcggccacgccccgtacaccgtcctgcgcgacgcctaccagcgcaacgccgagggactggtcgcgggcggcgcggacgcactgctggtggagaccacgcaggacctgctccagaccaaggcctcggtgctcggcgcccggcgcgccctggacgtcctcggcctcgacctgccgctcatcgtgtccgtcaccgtcgagaccaccggcaccatgctgctcggctcggagatcggcgccgcgctcaccgcgctggaaccgctcggcatcgacatgatcggcctgaactgcgccaccggccccgccgagatgagcgagcacctgcgctacctcgcccggcactcccgcatcccgctgacctgcatgcccaacgccggtctgcccgtcctcggcaaggacggcgcccactacccgctgaccgcgcccgagctggccgacgcacacgagaccttcgtgcgcgagtacggcctgtccctggtcggcggctgctgcggcaccacgcccgagcacctgcgccaggtcgtcgagcgggtccgggacaccgcccccaccgcacgcgacccgcgccccgagcccggcgccgcctcgctctaccagaccgtgcccttccgccaggacacctcctacctggccatcggcgagcgcaccaacgccaacgggtccaagaagttccgcgaggccatgctggacggccgctgggacgactgcgtcgagatggcccgcgaccagatccgcgaaggcgcgcacatgctcgacctctgcgtcgactacgtcggccgggacggcgtcgccgacatggaggaactggccggccggttcgccaccgcctccacgctgccgatcgtcctcgactccaccgaggtcgacgtcatccgggccggcctggagaagctcggcggccgcgcggtgatcaactcggtcaactacgaggacggcgccggccccgagtcccggttcgcccgcgtcacgaagctcgcccgggagcacggcgccgcgctgatcgcgctgaccatcgacgaggtgggacaggcccgcaccgccgagaagaaggtcgagatcgccgaacggctcatcgacgacctcaccggcaactggggcatccacgagtccgacatcctcgtcgactgcctgaccttcaccatctgcaccggccaggaggagtcccgcaaggacggcctggccaccatcgagggcatccgggaactcaagcggcgccacccggacgtgcagaccacgctcggcctgtcgaacatctccttcggcctcaacccggccgcccgcatcctgctcaactccgtcttcctcgacgaatgcgtcaaggccggcctggactcggccatcgtgcacgcgagcaagatcctgccgatcgcccgcttcgacgaggagcaggtcaccaccgccctcgacttgatctacgaccgccgccgcgagggctacgaccccctgcaaaagctcatgcagctcttcgagggcgccaccgccaagtcgctgaaggcctccaaggccgaggaactggccgccctcccgctggaggagcgcctcaagcgccgcatcatcgacggcgagaagaacggcctcgaacaggacctcgacgaggccctccgggagcgcccggccctcgagatcgtcaacgacaccctgctcgacggtatgaaggtcgtcggcgagctgttcggctccggccagatgcagctgccgttcgtgctccagtccgccgaggtcatgaagaccgcggtggcccacctggagccgcacatggagaagaccgacgacgacggcaagggcacgatcgtgctggccaccgtccgcggcgacgtccacgacatcggcaagaacctcgtcgacatcatcctgtccaacaacggctacaacgtcgtcaacctcggcatcaagcagcccgtctccgcgatcctggaagcggccgacgagcaccgggccgacgtcatcggcatgtccggcctcctcgtcaagtccacggtgatcatgaaggagaacctggaggagctgaaccagcgcaagctggccgccgactacccggtcatcctcggcggcgccgccctcaccagggcctacgtcgaacaggacctgcacgagatctacgacggcgaggtccgctacgcccgcgacgccttcgagggcctgcgcctcatggacgccctcatcggcatcaagcgcggcgtgcccggcgccaagctgccggagctgaagcagcgccgggtgcgggccgccaccgtcgagatcgacgagcgccccgaggaaggccacgtccgctccgacgtcgccaccgacaacccggtcccgaccccgcccttccgcggcacccgcgtcgtcaagggcatccagctcaaggagtacgcctcctggctcgacgagggcgccctcttcaagggccagtggggcctcaagcaggcccgcaccggcgagggaccctcctacgaggaactggtcgagtccgagggccggccgcggctgcgcggcctgctcgaccggctccagacggacaaccttttggaggcggccgtggtctacggctacttcccctgcgtctccaaggacgacgacctgatcgtcctcgacgacgacggcaacgaacgcacccgcttcaccttcccccgccagcgccgcggccggcgcctgtgcctggccgacttcttccgcccggaggagtccggcgagaccgacgtggtcggcttccaggtcgtcaccgtcggctcccgcatcggcgaggagacggcccgcatgttcgaggccaacgcctaccgcgactatctcgagctgcacggcctgtccgtgcagctcgccgaggccctcgccgagtactggcacgcgcgcgtgcgctcggaactcggcttcgccggggaggacccggccgagatggaggacatgttcgccctgaagtaccggggtgcccgcttctccctcggctacggcgcctgccccgacctggaggaccgcgccaagatcgccgccctgctggagcccgagcgcatcggcgtccacctatccgaggagttccagctccaccccgagcagtccaccgacgccatcgtcatccaccacccggaggccaagtacttcaacgcccgctgagggatatcgtcgacatcgatgctcttctgcgttaattaacaattgggatcctctagacccgggatttaaatcgctagcgggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgctagcggcgcgccggccggcccggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaaggccggccgcggccgcgcaaagtcccgcttcgtgaaaattttcgtgccgcgtgattttccgccaaaaactttaacgaacgttcgttataatggtgtcatgaccttcacgacgaagtactaaaattggcccgaatcatcagctatggatctctctgatgtcgcgctggagtccgacgcgctcgatgctgccgtcgatttaaaaacggtgatcggatttttccgagctctcgatacgacggacgcgccagcatcacgagactgggccagtgccgcgagcgacctagaaactctcgtggcggatcttgaggagctggctgacgagctgcgtgctcggccagcgccaggaggacgcacagtagtggaggatgcaatcagttgcgcctactgcggtggcctgattcctccccggcctgacccgcgaggacggcgcgcaaaatattgctcagatgcgtgtcgtgccgcagccagccgcgagcgcgccaacaaacgccacgccgaggagctggaggcggctaggtcgcaaatggcgctggaagtgcgtcccccgagcgaaattttggccatggtcgtcacagagctggaagcggcagcgagaattatcgcgatcgtggcggtgcccgcaggcatgacaaacatcgtaaatgccgcgtttcgtgtgccgtggccgcccaggacgtgtcagcgccgccaccacctgcaccgaatcggcagcagcgtcgcgcgtcgaaaaagcgcacaggcggcaagaagcgataagctgcacgaatacctgaaaaatgttgaacgccccgtgagcggtaactcacagggcgtcggctaacccccagtccaaacctgggagaaagcgctcaaaaatgactctagcggattcacgagacattgacacaccggcctggaaattttccgctgatctgttcgacacccatcccgagctcgcgctgcgatcacgtggctggacgagcgaagaccgccgcgaattcctcgctcacctgggcagagaaaatttccagggcagcaagacccgcgacttcgccagcgcttggatcaaagacccggacacggagaaacacagccgaagttataccgagttggttcaaaatcgcttgcccggtgccagtatgttgctctgacgcacgcgcagcacgcagccgtgcttgtcctggacattgatgtgccgagccaccaggccggcgggaaaatcgagcacgtaaaccccgaggtctacgcgattttggagcgctgggcacgcctggaaaaagcgccagcttggatcggcgtgaatccactgagcgggaaatgccagctcatctggctcattgatccggtgtatgccgcagcaggcatgagcagcccgaatatgcgcctgctggctgcaacgaccgaggaaatgacccgcgttttcggcgctgaccaggctttttcacataggctgagccgtggccactgcactctccgacgatcccagccgtaccgctggcatgcccagcacaatcgcgtggatcgcctagctgatcttatggaggttgctcgcatgatctcaggcacagaaaaacctaaaaaacgctatgagcaggagttttctagcggacgggcacgtatcgaagcggcaagaaaagccactgcggaagcaaaagcacttgccacgcttgaagcaagcctgccgagcgccgctgaagcgtctggagagctgatcgacggcgtccgtgtcctctggactgctccagggcgtgccgcccgtgatgagacggcttttcgccacgctttgactgtgggataccagttaaaagcggctggtgagcgcctaaaagacaccaagggtcatcgagcctacgagcgtgcctacaccgtcgctcaggcggtcggaggaggccgtgagcctgatctgccgccggactgtgaccgccagacggattggccgcgacgtgtgcgcggctacgtcgctaaaggccagccagtcgtccctgctcgtcagacagagacgcagagccagccgaggcgaaaagctctggccactatgggaagacgtggcggtaaaaaggccgcagaacgctggaaagacccaaacagtgagtacgcccgagcacagcgagaaaaactagctaagtccagtcaacgacaagctaggaaagctaaaggaaatcgcttgaccattgcaggttggtttatgactgttgagggagagactggctcgtggccgacaatcaatgaagctatgtctgaatttagcgtgtcacgtcagaccgtgaatagagcacttaaggtctgcgggcattgaacttccacgaggacgccgaaagcttcccagtaaatgtgccatctcgtaggcagaaaacggttcccccgtagggtctctctcttggcctcctttctaggtcgggctgattgctcttgaagctctctaggggggctcacaccataggcagataacgttccccaccggctcgcctcgtaagcgcacaaggactgctcccaaagatcttcaaagccactgccgcgactgccttcgcgaagccttgccccgcggaaatttcctccaccgagttcgtgcacacccctatgccaagcttctttcaccctaaattcgagagattggattcttaccgtggaaattcttcgcaaaaatcgtcccctgatcgcccttgcgacgttggcgtcggtgccgctggttgcgcttggcttgaccgacttgatcagcggccgctcgatttaaatc

We claim:

1. A method for the fermentative production of at least one sulfur-containing fine chemical selected from L-methionine and S-adenosylmethionine, which comprises the following steps:
   a) fermenting a coryneform bacteria culture thereby producing the desired sulfur-containing fine chemical, wherein the coryneform bacteria expresses at least one heterologous nucleotide sequence which codes for a protein with methionine synthase (metH) activity, wherein the metH-encoding sequence is selected from the group consisting of:
      1) a nucleic acid molecule comprising the nucleotide sequence of SEQ ID NO:1, or a complement thereof; and
      2) a nucleic acid molecule comprising a nucleotide sequence encoding a protein comprising an amino acid sequence which is at least 95% identical to the entire amino acid sequence of SEQ ID NO:2, or a complement thereof;
   and wherein said sequence is less than 70% identical to the entire metH-encoding sequence from *Corynebacterium glutamicum* ATCC 13032;
   b) concentrating the sulfur-containing fine chemical in the medium or in the bacterial cells, and
   c) isolating the sulfur-containing fine chemical.

2. The method of claim 1 wherein the sulfur-containing fine chemical comprises L-methionine.

3. The method of claim 1, wherein the coding metH sequence is a DNA or RNA which can be replicated in coryneform bacteria or is stably integrated into the chromosome of the coryneform bacteria.

4. The method of claim 3, wherein the coryneform bacteria is transformed with a plasmid vector comprising at least one copy of the coding metH sequence under the control of a regulatory sequence.

5. The method of claim 1, wherein the coding metH sequence is overexpressed.

6. The method of claim 1, wherein the coryneform bacteria further comprises the aspartate kinase-encoding gene lysC that is overexpressed or mutated such that the aspartate kinase-encoding gene lysC encodes a protein having an isoleucine at amino acid residue 311 and the activity of the encoded protein is influenced by metabolic metabolites to a smaller extent.

7. The method of claim 1, wherein the coryneform bacteria is of the species *Corynebacterium glutamicum*.

8. The method of claim 1, wherein the coryneform bacteria is resistant to a methionine biosynthesis inhibitor.

9. A method for producing an L-methionine-containing animal feed additive from fermentation broths, which comprises the following steps:
   a) culturing and fermenting of an L-methionine-producing microorganism in a fermentation medium; wherein the microorganism expresses at least one heterologous nucleotide sequence which codes for a protein with methionine synthase (metH) activity, wherein the metH-encoding sequence is selected from the group consisting of (a) a nucleic acid molecule comprising the nucleotide sequence of SEQ ID NO:1, or a complement thereof, and (b) a nucleic acid molecule comprising a nucleotide sequence encoding a protein comprising an amino acid sequence which is at least 95% identical to the entire amino acid sequence of SEQ ID NO:2, or a complement thereof;
   b) removing water from the L-methionine-containing fermentation broth;
   c) removing from 0 to 100% by weight of the biomass formed during fermentation; and
   d) drying the fermentation broth obtained according to b) and/or c), in order to obtain the animal feed additive in the desired powder or granule form.

10. The method of claim 3, wherein the coding metH sequence is integrated into the chromosome of the coryneform bacteria.

* * * * *